United States Patent 7,026,121 (METHODS AND COMPOSITIONS FOR DIAGNOSING AND MONITORING TRANSPLANT REJECTION) - sequence listing, part 2

SEQ ID NO: 4134 - DNA, 50 bp, Homo sapiens
taacttcaatgtagttttccatccttcaaataaacatgtctgcccccatg

SEQ ID NO: 4135 - DNA, 50 bp, Homo sapiens
gagtccttttgatttttaacttattccccatgtccctatacttcgtgtgc

SEQ ID NO: 4136 - DNA, 50 bp, Homo sapiens; identical to SEQ ID NO: 2854

SEQ ID NO: 4137 - DNA, 50 bp, Homo sapiens
cagcttcagctaggagtttgtaagcaaggactttgtgacacatttgtccc

SEQ ID NO: 4138 - DNA, 50 bp, Homo sapiens
aattgaaaagtaccaagaagtggaagaagaccaagacccatcatgcccca

SEQ ID NO: 4139 - DNA, 50 bp, Homo sapiens
acttcctagagacttgtttctgagacagttctttgccttcacttccctgc

SEQ ID NO: 4140 - DNA, 50 bp, Homo sapiens
acaactgacctgtctccttcacatagtccatatcaccacaaatcacacaa

SEQ ID NO: 4141 - DNA, 50 bp, Homo sapiens
gctcaggagcgggctgctgagagctaaacccagcaattttctatgatttt

SEQ ID NO: 4142 - DNA, 50 bp, Homo sapiens
aaagaaagccagtatattggtttgaaatatagagatgtgtcccaatttca

SEQ ID NO: 4143 - DNA, 50 bp, Homo sapiens
actggcaggcttatttatctgttgcacttggttagctttaattgttctgt

SEQ ID NO: 4144 - DNA, 50 bp, Homo sapiens; identical to SEQ ID NO: 2256

SEQ ID NO: 4145 - DNA, 50 bp, Homo sapiens
caactgtgctggccgggaggagagcagagacgcagtcctgcccagtgtag

SEQ ID NO: 4146 - DNA, 50 bp, Homo sapiens
cacatggctaaagaaggtttcagaaagaagtggggacagagcagaacttt

SEQ ID NO: 4147 - DNA, 50 bp, Homo sapiens
ccgacatctggttcctacttcagggtcataaagcctaaatagcccacacg

SEQ ID NO: 4148 - DNA, 50 bp, Homo sapiens
ctcatttgtattcaagcctttaacaggagggcaaagaggtgagaatgtgt

SEQ ID NO: 4149 - DNA, 50 bp, Homo sapiens; identical to SEQ ID NO: 1928

SEQ ID NO: 4150 - DNA, 50 bp, Homo sapiens
gcagacactgcttcttacttctgtgctacggatgggaacagagatgacaa

SEQ ID NO: 4151 - DNA, 50 bp, Homo sapiens
ggggaaactggaggcttcaaaactatctttggagcaggaacaagactatt

SEQ ID NO: 4152 - DNA, 50 bp, Homo sapiens
ggggaaggagggtgattatattgctttgtaatggtttgtgatacttgaaa

SEQ ID NO: 4153 - DNA, 50 bp, Homo sapiens
gtacgaatgggaggtcctcgacacctggggaactgcggactatgcggcag

SEQ ID NO: 4154 - DNA, 50 bp, Homo sapiens; identical to SEQ ID NO: 2478

SEQ ID NO: 4155 - DNA, 50 bp, Homo sapiens
tgacctccaccaaagcccatataaggagcggagttgttaaggactgaaga

SEQ ID NO: 4156 - DNA, 50 bp, Homo sapiens
tttctccggactcatcagtaaacctgtagaagtgtcgctttccagccttt

SEQ ID NO: 4157 - DNA, 50 bp, Homo sapiens; identical to SEQ ID NO: 3153

SEQ ID NO: 4158 - DNA, 50 bp, Homo sapiens
aaagttgatactgtgggttatttttgtgaacagcctgatgtttgggacct

SEQ ID NO: 4159 - DNA, 50 bp, Homo sapiens
aacttttacactttttccttccaacacttcttgattggctttgcagaaat

SEQ ID NO: 4160 - DNA, 50 bp, Homo sapiens
acagccaagacttaggttacagggcaacgcactactgttcagctttgaat

SEQ ID NO: 4161 - DNA, 50 bp, Homo sapiens
acgtgtcctgattttgccacaacctggatattgaagctatccaagctttt

SEQ ID NO: 4162 - DNA, 50 bp, Homo sapiens; identical to SEQ ID NO: 2915

SEQ ID NO: 4163 - DNA, 50 bp, Homo sapiens; identical to SEQ ID NO: 923

SEQ ID NO: 4164 - DNA, 50 bp, Homo sapiens
ccaatgacagcctacctattaccaagggctcccctacaactctgaacctt

SEQ ID NO: 4165 - DNA, 50 bp, Homo sapiens
gacaaaccctggagaaatgggagcttggggagaggatgggagtgggcaga

SEQ ID NO: 4166 - DNA, 50 bp, Homo sapiens
gtgtcagtgcccaaaggagggaggttgatggtgcttaacaaacatgaagt

SEQ ID NO: 4167 - DNA, 50 bp, Homo sapiens
tcattgtataaaagctgttatgtgcaacagtgtggagattccttgtctga

SEQ ID NO: 4168 - DNA, 50 bp, Homo sapiens; identical to SEQ ID NO: 4155

SEQ ID NO: 4169 - DNA, 50 bp, Homo sapiens
ttggcttcattacgagagagaaacataacagaggcagtgatggtttcaga

SEQ ID NO: 4170 - DNA, 50 bp, Homo sapiens; identical to SEQ ID NO: 3706

SEQ ID NO: 4171 - DNA, 50 bp, Homo sapiens
agcacattgggagatacatgataaatttctatctgcagttgctatttgca

SEQ ID NO: 4172 - DNA, 50 bp, Homo sapiens
ggcccagcagaagagcctccttcagcagctactgactgaataaccacttt

SEQ ID NO: 4173 - DNA, 50 bp, Human cytomegalovirus
aataatagattagcagaaggaataatccgtgcgaccgagcttgtgcttct

SEQ ID NO: 4174 - DNA, 50 bp, Human cytomegalovirus
acattcaaaagtttgagcgtcttcatgtacgccgttttcggcctcacgag

SEQ ID NO: 4175 - DNA, 50 bp, Human cytomegalovirus
acgaacagaaatctcaaaagacgctgacccgataagtaccgtcacggaga

SEQ ID NO: 4176 - DNA, 50 bp, Human cytomegalovirus
aggaaccagcaagtcaacaaaagactaacaaagaaaaaccatcttggaat

SEQ ID NO: 4177 - DNA, 50 bp, Human cytomegalovirus
ccaacgacacatccacaaaaatcccccatcgactctcacaatcgcatcat

SEQ ID NO: 4178 - DNA, 50 bp, Human cytomegalovirus
cctctggaggcaagagcacccaccctatggtgactagaagcaaggctgac

SEQ ID NO: 4179 - DNA, 50 bp, Human cytomegalovirus
gatgtccgtctacgcgctatcggccatcatcggcatctatctgctctacc

SEQ ID NO: 4180 - DNA, 50 bp, Human cytomegalovirus
ttcgtgggcaccaagtttcgcaagaactacactgtctgctggccgagttt

SEQ ID NO: 4181 - DNA, 50 bp, Human cytomegalovirus
gagatcgacatcgtcatcgaccgacctccgcagcaacccctacccaatcc

SEQ ID NO: 4182 - DNA, 50 bp, Human cytomegalovirus
ctttgagcaggttctcaaggctgtaactaacgtgctgtcgcccgtctttc

SEQ ID NO: 4183 - DNA, 50 bp, Human cytomegalovirus
tcttctgggacgccaacgacatctaccgcatcttcgccgaattggaaggc

SEQ ID NO: 4184 - DNA, 50 bp, Human cytomegalovirus
agagaacaacaaaaccaccacgacgatgaaacaaaacgctcaaccaaaca

SEQ ID NO: 4185 - DNA, 50 bp, Human cytomegalovirus
gagaaaagattgtgcgatctccccctggtttccagcagactcttgccaga

SEQ ID NO: 4186 - DNA, 50 bp, Human cytomegalovirus
catcttctccaccaaccagggtgggttcatgctgcctatctacgagacgg

SEQ ID NO: 4187 - DNA, 50 bp, Homo sapiens
tcccatgttccctttatttgtcttttggttctgctttttgggagattttt

SEQ ID NO: 4188 - DNA, 50 bp, Homo sapiens
tggtgcgcttttgtgtgcggtggaggagttcctaaccctcggcttgtttt

SEQ ID NO: 4189 - DNA, 50 bp, Homo sapiens
gccgttggttggcttaaacttggtttcgtcacttcgggcactttggtttt

SEQ ID NO: 4190 - DNA, 50 bp, Homo sapiens
ctggcctcccctggctctttaagctcccctttggttaaaaactgggtttt

SEQ ID NO: 4191 - DNA, 50 bp, Homo sapiens
aaaaggccaagggtgttgttggggcgtctgtctaatgtggtgggtctttt

SEQ ID NO: 4192 - DNA, 50 bp, Homo sapiens
gctgtaaatctctgtctcatcatccttctcttttgtttccatagcctttt

SEQ ID NO: 4193 - DNA, 50 bp, Homo sapiens
gtgtgtgctggctgagaagccactgtgaattgattcttcttctgaagttt

SEQ ID NO: 4194 - DNA, 50 bp, Homo sapiens
aataagggtgttgccctttgttccctcacataatcgtgaaaggctgcttt

SEQ ID NO: 4195 - DNA, 50 bp, Homo sapiens
ttcctcagtccctgttcataccatctctgcacccacaatcacactgattt

SEQ ID NO: 4196 - DNA, 50 bp, Homo sapiens
gaccacagatatgcactccttacattaacctcagccttgatgtatcattt

SEQ ID NO: 4197 - DNA, 50 bp, Homo sapiens
ccccctgttatgaaaagggttaaacttgaacccacccattttaaaaattt

SEQ ID NO: 4198 - DNA, 50 bp, Homo sapiens
ttatagctaccagaagccaccagggccttagcccagcagtagaaacctct

SEQ ID NO: 4199 - DNA, 50 bp, Homo sapiens
gatcagtagacacacccctcaatgctgcgaagaaaatgaaggccactctt

SEQ ID NO: 4200 - DNA, 50 bp, Homo sapiens
agcagacaatggacaactgtagtttttgaattgacttctatagccatctt

SEQ ID NO: 4201 - DNA, 50 bp, Homo sapiens
tccaccacagtgcatgataattccgacagaacggccttttatttgtacct

SEQ ID NO: 4202 - DNA, 50 bp, Homo sapiens
tgttctctgaactgtctggatgaaccggtcaacggcactcatcatacctt

SEQ ID NO: 4203 - DNA, 50 bp, Homo sapiens
gcttcactctgctttctgtataaagggcagtctgtggtcacgcaagactt

SEQ ID NO: 4204 - DNA, 50 bp, Homo sapiens
agcaaagaccaaattctccttgggaagtgtgggagcaggctgacattatt

SEQ ID NO: 4205 - DNA, 50 bp, Homo sapiens
gtcctttgatagcagaacaagaggctctgtgatcctctggacctcagatt

SEQ ID NO: 4206 - DNA, 50 bp, Homo sapiens
tccacgacatggtacagctcttcactttttcagctttttaaatgtccatt

SEQ ID NO: 4207 - DNA, 50 bp, Homo sapiens
gacaaggcaatgctactgatcacctgaggataatggtgaaggacttttgt

SEQ ID NO: 4208 - DNA, 50 bp, Homo sapiens
tcaatagttgtgaaattcttctcaggctccttaaaccctcgctttgttgt

SEQ ID NO: 4209 - DNA, 50 bp, Homo sapiens
aggcttacgtttatccaaaagcatttcaccttgcacattactgttgttgt

SEQ ID NO: 4210 - DNA, 50 bp, Homo sapiens
acaagcatttagatcataacatggtaaagcctattaccagccaatgttgt

SEQ ID NO: 4211 - DNA, 50 bp, Homo sapiens
tgttttggcatagagctttacttaaaatgctgcttcattttacacattgt

SEQ ID NO: 4212 - DNA, 50 bp, Homo sapiens
tggagctcaattctatgcagttgtgctgatatttcattaagtcactgtgt

SEQ ID NO: 4213 - DNA, 50 bp, Homo sapiens
tttccccttggcctgagtttttataaaatttccattaattggggcagtgt

SEQ ID NO: 4214 - DNA, 50 bp, Homo sapiens
tgcagctaaattcgaagcttttggtctatattgttaattgccattgctgt

SEQ ID NO: 4215 - DNA, 50 bp, Homo sapiens
ggatttggaagatgctttcagaaatatggcataggtttttgtcgaaatgt

SEQ ID NO: 4216 - DNA, 50 bp, Homo sapiens
aaagaaaaattcagcctgaaccctacccttataaaacaggttaattgggt

SEQ ID NO: 4217 - DNA, 50 bp, Homo sapiens
tgtaagtcccatgcccgaatttggagatttgggtttttcttttcaggggt

SEQ ID NO: 4218 - DNA, 50 bp, Homo sapiens
cggattccaaattacttaaagcctttatgggaacacggtagattgtaggt

SEQ ID NO: 4219 - DNA, 50 bp, Homo sapiens
gccttctggcctctgaggcaaaggtcagtgatactgatgggagggtaggt

SEQ ID NO: 4220 - DNA, 50 bp, Homo sapiens
gctcaagatcacctctttgtcatcttgaacaatgtttttctcttctaggt

SEQ ID NO: 4221 - DNA, 50 bp, Homo sapiens
tgtttccacttcatgggatatgactccatcacaatgaaaatgggtccagt

SEQ ID NO: 4222 - DNA, 50 bp, Homo sapiens
ttgtgattgtaaatcatgtatgtacaaatgccatgaaaattaaagccagt

SEQ ID NO: 4223 - DNA, 50 bp, Homo sapiens
tttcccttatgcaccttccagtctttggcaggacatgatttatggacagt

SEQ ID NO: 4224 - DNA, 50 bp, Homo sapiens
tgcactctaccagatttgaacatctagtgaggttcacattcatactaagt

SEQ ID NO: 4225 - DNA, 50 bp, Homo sapiens
tcaactgcagggaatctcctaggaagcggataaatctggcaattggaagt

SEQ ID NO: 4226 - DNA, 50 bp, Homo sapiens
accaccagctatttgtaattccttcttctaaggcatagtgaaaacttgct

SEQ ID NO: 4227 - DNA, 50 bp, Homo sapiens
tcgctttctaactgattccattccaccatgtcagatactcctgggctgct

SEQ ID NO: 4228 - DNA, 50 bp, Homo sapiens
cagcaatgaggggatatttttgatgagctggaatatccaattgaacagct

SEQ ID NO: 4229 - DNA, 50 bp, Homo sapiens
ccccctaagttaaaagctctgtctttttggggtttgccctatgtaaagct

SEQ ID NO: 4230 - DNA, 50 bp, Homo sapiens
gaagcctctactcttgagtctctttcattactggggatgtaaatgttcct

SEQ ID NO: 4231 - DNA, 50 bp, Homo sapiens
acacttgatctcttccttatttctctcagaaaacctgtaggattgtgcct

SEQ ID NO: 4232 - DNA, 50 bp, Homo sapiens
agtagatattttgccggtgtacttggaatacctttcagaagccaaaccct

SEQ ID NO: 4233 - DNA, 50 bp, Homo sapiens
aattccaatcctggtatatagcacctggtattatgggtaccaaaaaccct

SEQ ID NO: 4234 - DNA, 50 bp, Homo sapiens
actgctccaaatatcaaccccatgtaggcaggatgtttgatcttggtact

SEQ ID NO: 4235 - DNA, 50 bp, Homo sapiens
tgttgttggatacgtacttaactggtatgcatcccatgtctttgggtact

SEQ ID NO: 4236 - DNA, 50 bp, Homo sapiens
ttaggattgctcagtttcatcaaggtttgaaggataggcaggctctcact

SEQ ID NO: 4237 - DNA, 50 bp, Homo sapiens
ggccagtctctgtgtgtcttaatcccttgtccttcattaaaagcaaaact

SEQ ID NO: 4238 - DNA, 50 bp, Homo sapiens
gcattcccggtcactccctccctaatctgagcatcactcaagctctttat

SEQ ID NO: 4239 - DNA, 50 bp, Homo sapiens
ctgaatgccaagagcttcaagagtgtgtgtaaataaagccacacctttat

SEQ ID NO: 4240 - DNA, 50 bp, Homo sapiens
cccgaggaggaagacgaatcgttaaacatctgaaagggtcaggtgagtat

SEQ ID NO: 4241 - DNA, 50 bp, Homo sapiens
caaacttgttctgaagacaatttccaaggttgtcagccatgtcaccatat

SEQ ID NO: 4242 - DNA, 50 bp, Homo sapiens
tcaggttcgtgttaaacgctgtatgttaactatgactggaattctgtgat

SEQ ID NO: 4243 - DNA, 50 bp, Homo sapiens
atggagatccagagacgttggttttcaaatggagcaaacagcactgtgat

SEQ ID NO: 4244 - DNA, 50 bp, Homo sapiens
agctttaggctgagggcatggaaactgttacgcttttccttttatgtgat

SEQ ID NO: 4245 - DNA, 50 bp, Homo sapiens
tcactccagaatagaaattagagtataggtaggcagtccaacctctgcat

SEQ ID NO: 4246 - DNA, 50 bp, Homo sapiens
tcagatgccacacttatgagaccctcatccttctgctcactctcttccat

SEQ ID NO: 4247 - DNA, 50 bp, Homo sapiens
ccctgcctttacctctctacttgtagtgttctttcagagcctgctcccat

SEQ ID NO: 4248 - DNA, 50 bp, Homo sapiens
caaaacaagatgtgccagggcctgggggatgggataatttcagagagaat

SEQ ID NO: 4249 - DNA, 50 bp, Homo sapiens
acccaagagggcagcagttgtgtcatccagttcatcttaagaatttcaat

SEQ ID NO: 4250 - DNA, 50 bp, Homo sapiens
ggggtaggaagaggatggaattgagatgtttgagcctcatttacatcaat

SEQ ID NO: 4251 - DNA, 50 bp, Homo sapiens
gctctctgatgctggtggctgttcccccagaatggaagcattgattaaat

SEQ ID NO: 4252 - DNA, 50 bp, Homo sapiens
ggggagaagtgatatggtgaagggaagtggggagtatttgaacacagttg

SEQ ID NO: 4253 - DNA, 50 bp, Homo sapiens
caccatgcctcacttttagcgcagtgtgatcctacacaaattgccctgtg

SEQ ID NO: 4254 - DNA, 50 bp, Homo sapiens
tatggtttttaggctatgcagatattctgttggtttttgagacagctctg

SEQ ID NO: 4255 - DNA, 50 bp, Homo sapiens
ccttcctttctaaggcataagtgcgacgttcgctgctgtgcgtggaactg

SEQ ID NO: 4256 - DNA, 50 bp, Homo sapiens
gagaggaaggcagacaggcagccattttaagagagaagagccagacaatg

SEQ ID NO: 4257 - DNA, 50 bp, Homo sapiens
gttatcaaaggtggaatcggaaacaccaggctcctagtgccacggaaatg

SEQ ID NO: 4258 - DNA, 50 bp, Homo sapiens
aaatgtgcctattgctagagctcctccctctcaacacccagtttccttgg

SEQ ID NO: 4259 - DNA, 50 bp, Homo sapiens
caatcgtcttatctctacagagagaagtggaaaattctttttcaaggggg

SEQ ID NO: 4260 - DNA, 50 bp, Homo sapiens
ctatggaaggcagttggtgggcaaaagtccggtttttacgctttgagggg

SEQ ID NO: 4261 - DNA, 50 bp, Homo sapiens
gtctgatccttagaccgtctcatcacagcaaccctaactgcagagcaggg

SEQ ID NO: 4262 - DNA, 50 bp, Homo sapiens
aatggtaagaaatgccttgtgtgggtggccctccagtccccagtccaggg

SEQ ID NO: 4263 - DNA, 50 bp, Homo sapiens
aacatatccagggaggacaaactctgggctggacaatgtatccacaaggg

SEQ ID NO: 4264 - DNA, 50 bp, Homo sapiens
gcccatggtcctagaattaattcccctaaaaatttttgaaataggggcgg

SEQ ID NO: 4265 - DNA, 50 bp, Homo sapiens
gccaactgcttagaagcccaacacaacccatctggtctcttgaataaagg

SEQ ID NO: 4266 - DNA, 50 bp, Homo sapiens
gagcccttaaaattactgtatctcctctaaagtgtgatttaatggctgcg

SEQ ID NO: 4267 - DNA, 50 bp, Homo sapiens
cttttgctggagactcatcgctttgggaagtgcatttgcttcgtcgtccg

SEQ ID NO: 4268 - DNA, 50 bp, Homo sapiens
cccagttcacagtagagaggtggagcttagtacttcctgctgcccattag

SEQ ID NO: 4269 - DNA, 50 bp, Homo sapiens
ctgggctgtaggtactgctgggtcactgttgctataaatggtcactggag

SEQ ID NO: 4270 - DNA, 50 bp, Homo sapiens
ctttagatgtcccacgtcccttcaagcacatgaaagagctcacactggag

SEQ ID NO: 4271 - DNA, 50 bp, Homo sapiens
gactctggaactcgagcgtgtggctgctgcgccgacagctgaatctagag

SEQ ID NO: 4272 - DNA, 50 bp, Homo sapiens
ccttagagatcgtgacccttcctgcttgcctccctggtgggctctttcag

SEQ ID NO: 4273 - DNA, 50 bp, Homo sapiens
agagtgagaaggcagttccagttttagcacagatttgtttatgtgttcag

SEQ ID NO: 4274 - DNA, 50 bp, Homo sapiens
tctcaagagagaacgccacagcagagagacccaatccgcctaagttgcag

SEQ ID NO: 4275 - DNA, 50 bp, Homo sapiens
aggtttggggaggggtcccagtctgcgatcctttctccctcttcgtgcag

SEQ ID NO: 4276 - DNA, 50 bp, Homo sapiens
cctcagcttccaactctgattccaggacaggatggaaaacctttggacag

SEQ ID NO: 4277 - DNA, 50 bp, Homo sapiens
aatcccttgtaccatgtatacaaatgagacaagtgagcttgacattcaag

SEQ ID NO: 4278 - DNA, 50 bp, Homo sapiens
gctacagcccggaacacaaaagaagacacccatgcaaataccattaaaag

SEQ ID NO: 4279 - DNA, 50 bp, Homo sapiens
attaaccctttattgccctagccagtggggtgggagggagagattgtttc

SEQ ID NO: 4280 - DNA, 50 bp, Homo sapiens
gttatccttaggccaggtctcccacctttgagccggacaaaaccagagtc

SEQ ID NO: 4281 - DNA, 50 bp, Homo sapiens
tgctgctacagttgcaaaacactggagctagagaaaataaagtactgatc

SEQ ID NO: 4282 - DNA, 50 bp, Homo sapiens
cgagagtcttgctgagccaggacttgagtgcctcgaagttttcaatgatc

SEQ ID NO: 4283 - DNA, 50 bp, Homo sapiens
atcaggagagggagataattagttgcttcctccttcacactgtttgaatc

SEQ ID NO: 4284 - DNA, 50 bp, Homo sapiens
ttgccctttcctctcactgccttttatagccaatatcaatgtctctttgc

SEQ ID NO: 4285 - DNA, 50 bp, Homo sapiens
atccctattgccagacacatcattctctccatccagaaagccaactttgc

SEQ ID NO: 4286 - DNA, 50 bp, Homo sapiens
ctctcttcatcttctgattgggattgtgtccagtcctctgcttcttctgc

SEQ ID NO: 4287 - DNA, 50 bp, Homo sapiens
gagggttctagcaacttaatcccattagcatgttagctgaagactactgc

SEQ ID NO: 4288 - DNA, 50 bp, Homo sapiens
gtcccaagggtcagtatattggaggaaagtaaaggagtgaatcagactgc

SEQ ID NO: 4289 - DNA, 50 bp, Homo sapiens
ctggaattactaatgtggaggtgatctgagaactgggaacaaagtagggc

SEQ ID NO: 4290 - DNA, 50 bp, Homo sapiens
tccagggactgacaagagtgagtggtgtcaacctaaagagaaactcaggc

SEQ ID NO: 4291 - DNA, 50 bp, Homo sapiens
cagaactccatagacagcctcactttgtgctcgggggcctgtcccaaggc

SEQ ID NO: 4292 - DNA, 50 bp, Homo sapiens
gcacttctcccggttcatccctctcaagtaatggctcagctaataaaggc

SEQ ID NO: 4293 - DNA, 50 bp, Homo sapiens
tccatctcctttctactgtagcggagactacaagtcccaggatgccccgc

SEQ ID NO: 4294 - DNA, 50 bp, Homo sapiens
ccacattcttgctgtccacatcctgctgggtgaaattgtgttgaagtagc

SEQ ID NO: 4295 - DNA, 50 bp, Homo sapiens
tgactgtcttggtaattttcttccttgttttacttctggaaactgggagc

SEQ ID NO: 4296 - DNA, 50 bp, Homo sapiens
tgactttcaggaatgtcagcattgacctctccttgccactgttactcagc

SEQ ID NO: 4297 - DNA, 50 bp, Homo sapiens
aagtttgtgcagcacattcctgagtgtacgatattgacctgtagcccagc

SEQ ID NO: 4298 - DNA, 50 bp, Homo sapiens; identical to SEQ ID NO: 4297

SEQ ID NO: 4299 - DNA, 50 bp, Homo sapiens
accagacttcaggaagaataaaggtcgccaactcaataaaaccaccaagc

SEQ ID NO: 4300 - DNA, 50 bp, Homo sapiens
acttgccacataaacagttccatcataaaaactcttccccttcttgttcc

SEQ ID NO: 4301 - DNA, 50 bp, Homo sapiens
gcttccttgaaccacccagaaatccactcaaatttggggattgtcattcc

SEQ ID NO: 4302 - DNA, 50 bp, Homo sapiens
gggggtgatgggttaattaaataagtccattcctgggatttgagggggcc

SEQ ID NO: 4303 - DNA, 50 bp, Homo sapiens
atgcccctcgtcctagaattaattcccctaaaaatctttgaaatagggcc

SEQ ID NO: 4304 - DNA, 50 bp, Homo sapiens
tcaaactaagaccagggttgaaaactatggcccagggaccacttccagcc

SEQ ID NO: 4305 - DNA, 50 bp, Homo sapiens
gacgcgcacacaccttgagtgacagcgacctcttctctacaggttttccc

SEQ ID NO: 4306 - DNA, 50 bp, Homo sapiens
atccaagctttaattctgccatctcagaatggtgataaaccatttctccc

SEQ ID NO: 4307 - DNA, 50 bp, Homo sapiens
tacttcattgctattgtaaaccaaaaataaaatttgaagccccctgcccc

SEQ ID NO: 4308 - DNA, 50 bp, Homo sapiens
cttcatcactcaggaaacagaaaaggcttcagaaggagcggccatgcccc

SEQ ID NO: 4309 - DNA, 50 bp, Homo sapiens
agaacccgtattcataaaatttagaccaaaaaggaaggaatcgaaccccc

SEQ ID NO: 4310 - DNA, 50 bp, Homo sapiens
ttttctattttcatctgtcattttcactgcagagcgcacctcccggaccc

SEQ ID NO: 4311 - DNA, 50 bp, Homo sapiens
agactgaaggggttgaaagacccgtagacgctcctttcctcttttagacc

SEQ ID NO: 4312 - DNA, 50 bp, Homo sapiens
ctctgcggccctagagttaatcccatcagccgaggtgaggcacctgttac

SEQ ID NO: 4313 - DNA, 50 bp, Homo sapiens
ccaattccgcagtacagagcattcagcaggtagtggtgaccctgggtgac

SEQ ID NO: 4314 - DNA, 50 bp, Homo sapiens
ggctccagccaccggcagctctgaaagagtttgaagaatttattgttcac

SEQ ID NO: 4315 - DNA, 50 bp, Homo sapiens; identical to SEQ ID NO: 238

SEQ ID NO: 4316 - DNA, 50 bp, Homo sapiens
cactggaacacaacccagccatgaaaaggaagaagctctgactcaggcac

SEQ ID NO: 4317 - DNA, 50 bp, Homo sapiens
catctcatgcgtagcactgatcaatgtgccccagggtgtgtattcgccac

SEQ ID NO: 4318 - DNA, 50 bp, Homo sapiens
caatcagagcgcgagttacaagcgcggtggagtggggaagcgaatgaaac

SEQ ID NO: 4319 - DNA, 50 bp, Homo sapiens
gacattgcacatttttgaacctgtctacagcagcctgggttggtcacaac

SEQ ID NO: 4320 - DNA, 50 bp, Homo sapiens
acactggcagagtccagaaaagcagcagaagaaaaattcagagcaaaaac

SEQ ID NO: 4321 - DNA, 50 bp, Homo sapiens
tttaacgtgcttctgagacagccaccaccgaaaggcacctttagcggtta

SEQ ID NO: 4322 - DNA, 50 bp, Homo sapiens
tcagccaacctgaatctggtatctttacttaaacacagcagttgtagtta

SEQ ID NO: 4323 - DNA, 50 bp, Homo sapiens
aaaaggagacgatgtcaggcaaacactccttaccctgccatttctagtta

SEQ ID NO: 4324 - DNA, 50 bp, Homo sapiens
tcacaatcagtctcagattcccagcagcagagagtgaattgtatgttgta

SEQ ID NO: 4325 - DNA, 50 bp, Homo sapiens
taaagacaatgctatttaagtgcacagttccaggggcgcttgtggctcta

SEQ ID NO: 4326 - DNA, 50 bp, Homo sapiens
gaagaccaagtctacgcctgcaagctctcagaccgggaacatccactcta

SEQ ID NO: 4327 - DNA, 50 bp, Homo sapiens
ctgaagagacagaaagggagacaccaaaactttaatggcagttattccta

SEQ ID NO: 4328 - DNA, 50 bp, Homo sapiens
gccgcccccatgaagccctttcttactgtaagtgctcaagaacaaagata

SEQ ID NO: 4329 - DNA, 50 bp, Homo sapiens
gctagcacgactctgccttgttcctttggagacaattgttatcatcaata

SEQ ID NO: 4330 - DNA, 50 bp, Homo sapiens
attgggaatatagatcatcaacagacacagccctggacgcataaatttga

SEQ ID NO: 4331 - DNA, 50 bp, Homo sapiens
actaacgtatttcatcatggaaggtcctgtggtgatggttttccctggga

SEQ ID NO: 4332 - DNA, 50 bp, Homo sapiens
aagtaatagctccctgtttgtgccttgttagggctagggatgtttaagga

SEQ ID NO: 4333 - DNA, 50 bp, Homo sapiens
agctcctccccttagtgaccccaagtctgtttccctcagctgcataagga

SEQ ID NO: 4334 - DNA, 50 bp, Homo sapiens
ccctcaaatctcccaatctactccagggaaaagacacttcaagtgagaga

SEQ ID NO: 4335 - DNA, 50 bp, Homo sapiens
acatgcaaacagtgacttacttagtgcttctgaaaaatttctgagtcaga

SEQ ID NO: 4336 - DNA, 50 bp, Homo sapiens
aatgcccattggtaagtcaacattgttttccctgaaagtcctgagacaga

SEQ ID NO: 4337 - DNA, 50 bp, Homo sapiens
ccatgtttgctgctgctgttgagtttctgtgctttgggagtataataaga

SEQ ID NO: 4338 - DNA, 50 bp, Homo sapiens
tgtgtttggttgggtgtaatgaggaaaatacctgataaaatgtctgaaga

SEQ ID NO: 4339 - DNA, 50 bp, Homo sapiens
tggataagtgaagacagtaataacattgaagcagtgaaccagtggaaaga

SEQ ID NO: 4340 - DNA, 50 bp, Homo sapiens
agcacaaaaatgttgaagtattaggcccaagctccatgtttggttagtca

SEQ ID NO: 4341 - DNA, 50 bp, Homo sapiens
cgtttaacaataataaaggtgactgcttcatctaaggaatccgagccgca

SEQ ID NO: 4342 - DNA, 50 bp, Homo sapiens
gggcattccaccgaaattcttggggaaatttagtagccttcattttagca

SEQ ID NO: 4343 - DNA, 50 bp, Homo sapiens
tccatgttctgtgcaagaaggagacacattttcagttgaggttcccagca

SEQ ID NO: 4344 - DNA, 50 bp, Homo sapiens
agctcaacactgtggtaggaaaatagccactagaaagaaaataaaaagca

SEQ ID NO: 4345 - DNA, 50 bp, Homo sapiens
gcatctccagggtttagcatcaggacagaggattaagtaaattctttcca

SEQ ID NO: 4346 - DNA, 50 bp, Homo sapiens
gagactacagagccttagcccctttaaagcccttaaagttactacttcca

SEQ ID NO: 4347 - DNA, 50 bp, Homo sapiens
agagcaagtctcagaaataatgctgtatctacactgtcatgtatttgcca

SEQ ID NO: 4348 - DNA, 50 bp, Homo sapiens
tggttctctgatttgtaatgagcacctggatatgtcaattaaaatgccca

SEQ ID NO: 4349 - DNA, 50 bp, Homo sapiens
gcaagactgttcagtattatgttagcattgatataaaaagaagcagacca

SEQ ID NO: 4350 - DNA, 50 bp, Homo sapiens
aatgttcccaaaggccaaatttgttgccaggttttatacgcaggtcacca

SEQ ID NO: 4351 - DNA, 50 bp, Homo sapiens
tgcctattgtgattatcgctatcactacatcccctgactaagggaaacca

SEQ ID NO: 4352 - DNA, 50 bp, Homo sapiens
acaaaattcactgcaggtcggtggaatgatagaatgcattttaaatcaca

SEQ ID NO: 4353 - DNA, 50 bp, Homo sapiens
ggacggttggctgaatggcaacagtgatggaatatttatatttagccaca

SEQ ID NO: 4354 - DNA, 50 bp, Homo sapiens
acattgcacatttaatagctgcaccagacactaagagttcctctcacaca

SEQ ID NO: 4355 - DNA, 50 bp, Homo sapiens
cgcttgtcctgtgagtagctcgtcacctgaggccttgtcgtgaatattaa

SEQ ID NO: 4356 - DNA, 50 bp, Homo sapiens
tggagcaaaccacagtttcatgcccatcgtcctagaattaattcccctaa

SEQ ID NO: 4357 - DNA, 50 bp, Homo sapiens
gggacaacacagtggatttgaaatctgaaggggcattggtggtactggaa

SEQ ID NO: 4358 - DNA, 50 bp, Homo sapiens
acctccatatcttctcgtacttgttcctgctggtctcttagctctccgaa

SEQ ID NO: 4359 - DNA, 50 bp, Homo sapiens
cgaggatggtttcctgatagctttcaaacacctttgccatctcttcgcaa

SEQ ID NO: 4360 - DNA, 50 bp, Homo sapiens
actcctgacagctcatcctgcaaaattaaaatccaaaatttaagtcgcaa

SEQ ID NO: 4361 - DNA, 50 bp, Homo sapiens
gctggatctctgcctaaagtcacggtaggatgagaagtagaaacgagcaa

SEQ ID NO: 4362 - DNA, 50 bp, Homo sapiens
tcagaccataggtgggtgttgtttcttttaagtgtgtgtactgtgtccaa

SEQ ID NO: 4363 - DNA, 50 bp, Homo sapiens
tcatctatgtagcttaatctcatcgacgtttcggttcatttcctgcacaa

SEQ ID NO: 4364 - DNA, 50 bp, Homo sapiens
ttccttttccgctaatcaagagtccagggaggtgggaacagcctcaacaa

SEQ ID NO: 4365 - DNA, 50 bp, Homo sapiens
ccggcagctgtgtttagcccctccagatggaagtttcacttgaatgtaaa

SEQ ID NO: 4366 - DNA, 50 bp, Homo sapiens
acaaaggaatgaagctttatgacagggcacgtgaaatgtttatagtgaaa

SEQ ID NO: 4367 - DNA, 50 bp, Homo sapiens
actaaaggtcacaacccattaacaaccatgaaattggtgttgggaagaaa

SEQ ID NO: 4368 - DNA, 50 bp, Homo sapiens
tgctcaggaaaccaaaaaggatgtctgcatggaggacaaaaaggcacaaa

SEQ ID NO: 4369 - DNA, 50 bp, Homo sapiens
tgagaaccgcgcaccctacccatcggccacgtgaccagtcctttttaaaa

SEQ ID NO: 4370 - DNA, 50 bp, Homo sapiens
gtctttgggtcagtgtcatcattctcttcaagtctggggcttggggaaaa

SEQ ID NO: 4371 - DNA, 50 bp, Homo sapiens
ctccacacaggagaatctcggcgatttacacccacaggctacgcagaaaa

SEQ ID NO: 4372 - DNA, 50 bp, Homo sapiens
gcgctgctcccaaaatctatctgctgtttaatagtttttacctttcaaaa

SEQ ID NO: 4373 - DNA, 50 bp, Homo sapiens
gggttcagggggttttccctttgcccgtttggccctgggtttaataaaaa

SEQ ID NO: 4374 - DNA, 50 bp, Homo sapiens
ccaactcctcacagggcaggctagcgggcaccaggtcgccggggaagtgg

SEQ ID NO: 4375 - DNA, 50 bp, Homo sapiens
cggctgagagcccggtagggcccaggggccaagcgcaggcagaggccgcg

SEQ ID NO: 4376 - DNA, 50 bp, Homo sapiens
cttggggtccagggcacagcggtgccggggacacagcagttccgagggtc

SEQ ID NO: 4377 - DNA, 50 bp, Homo sapiens
agtatggtaattagaaagcatgttagaacatgtggaaaaagggggaaaaa

SEQ ID NO: 4378 - DNA, 50 bp, Homo sapiens
catcagtcctcatcagctgaagtggcttcccaaggatttaaataaatagt

SEQ ID NO: 4379 - DNA, 50 bp, Homo sapiens
agacattgactacagggtaatttctatgattatattatttagaagtatga

SEQ ID NO: 4380 - DNA, 50 bp, Homo sapiens
ccagtgaactgttagcaacaatgcagaagaatctgcatgtaataaactga

SEQ ID NO: 4381 - DNA, 50 bp, Homo sapiens
acttaaatgccttttaatttttgtcgatgtaatagtttaataccagtaaa

SEQ ID NO: 4382 - DNA, 50 bp, Homo sapiens
tttttaattctagcttctttttaaagattatttgggtacctaataaagga

SEQ ID NO: 4383 - DNA, 50 bp, Homo sapiens
caaagcctccacaggagaccccacccagcagcccagcccctacccaggag

SEQ ID NO: 4384 - DNA, 50 bp, Homo sapiens
cgagtgacattggctgacatcacagttgtctgaacctgttgtggctctat

SEQ ID NO: 4385 - DNA, 50 bp, Homo sapiens
tgaattgcttcaaaacctcttccatctcagaagaccagaccctgggaact

SEQ ID NO: 4386 - DNA, 50 bp, Homo sapiens
gctgaagtggcaatagagagagtctgctagaaagacggaagtcaccatct

SEQ ID NO: 4387 - DNA, 50 bp, Homo sapiens
tctactgactatcctagaaatcgctgtcgccttaatccaagcctacgttt

SEQ ID NO: 4388 - DNA, 50 bp, Homo sapiens
gtgtgtgcttagccaaatacagtaactgtgactggcccagggatgttctc

SEQ ID NO: 4389 - DNA, 50 bp, Homo sapiens
gtgagtccaatgtatgctttagaagtaaagacattgaccgtcacagacca

SEQ ID NO: 4390 - DNA, 50 bp, Homo sapiens
ctcaagaaaagacagaagagacagtgatttgggatgagtctactctagga

SEQ ID NO: 4391 - DNA, 50 bp, Homo sapiens
accctatgcccattgtcctgatctgaaaattcttggaaattgttccatgt

SEQ ID NO: 4392 - DNA, 50 bp, Homo sapiens
ttcacagtcttctattgttggaccacttacattgtaccaaatgttttcct

SEQ ID NO: 4393 - DNA, 50 bp, Homo sapiens
attaagcccccgtagcccatcccgcaagttagatacagctatggttaagg

SEQ ID NO: 4394 - DNA, 50 bp, Homo sapiens
ttatattgtagtggtggtatttgctttccgcctgttggctacttcgaccc

SEQ ID NO: 4395 - DNA, 50 bp, Homo sapiens
ttgttctctgtcatgcccacaatccctttctaaggaagactgccctacta

SEQ ID NO: 4396 - DNA, 50 bp, Homo sapiens
actgaggacgaggctgactactactgtcagtcttatgatagcacctatca

SEQ ID NO: 4397 - DNA, 50 bp, Homo sapiens
agatggaggatgaagctgactactactgttactcaacagacagcagtggt

SEQ ID NO: 4398 - DNA, 50 bp, Homo sapiens
catgtcaatgtgtctgttgtcatggcggaggtggacggcacctgctactg

SEQ ID NO: 4399 - DNA, 50 bp, Homo sapiens
gtcaatgtgtctgttgtcatggcggaggtggacggcacctgctactgagc

SEQ ID NO: 4400 - DNA, 50 bp, Homo sapiens
tccaacctccagtttgaggatgaggctgattattactgtgagacctggga

SEQ ID NO: 4401 - DNA, 50 bp, Homo sapiens
gactacaactggcaatcccaactcctgggctagggctttttctacctttt

SEQ ID NO: 4402 - DNA, 50 bp, Homo sapiens
tatttctgtgcgagagttccccctaaacatggcggaggcttcttctacaa

SEQ ID NO: 4403 - DNA, 50 bp, Homo sapiens
tggctaggagaccttgggcagtacctacagtcttgctgtttctgtttcat

SEQ ID NO: 4404 - DNA, 50 bp, Homo sapiens
gtgagctgaacaaatacatcatttaaatctatgctgcactttgagttgct

SEQ ID NO: 4405 - DNA, 50 bp, Homo sapiens
cccgtgtgtttacagcatttccaggtccagagaggttggcagacaagtgc

SEQ ID NO: 4406 - DNA, 50 bp, Homo sapiens
agctgtgggatataagtagtggtcattatgtcttcggaggtggcaccact

SEQ ID NO: 4407 - DNA, 50 bp, Homo sapiens
gccctttgagaaagactttgttcctgaactgctcccttctcttttagggt

SEQ ID NO: 4408 - DNA, 50 bp, Homo sapiens
ggtctggttctagatcagccttttcagtctgccctggcctggtcattaat

SEQ ID NO: 4409 - DNA, 50 bp, Homo sapiens
gaaaaacctggctagagcagagcacaggatgtaaaagggtgggggagaac

SEQ ID NO: 4410 - DNA, 50 bp, Homo sapiens
ggttatctgagcataacagggacagggtgggccacaggatacctctgagg

SEQ ID NO: 4411 - DNA, 50 bp, Homo sapiens
acaagcaggagcacatcgctcttttatgaaagcccttcaacatttaacgt

SEQ ID NO: 4412 - DNA, 50 bp, Homo sapiens
cagggacaccacttatcctgcttccactatagcatgaatcagtgctctct

SEQ ID NO: 4413 - DNA, 50 bp, Homo sapiens
catcgcacacgaatttgaatcatctgctctttggaatcgcctacaccctg

SEQ ID NO: 4414 - DNA, 50 bp, Homo sapiens
tgtatgtaggtgtctgagcttcacaagccttttatagtccattcagcact

SEQ ID NO: 4415 - DNA, 50 bp, Homo sapiens
cgacgacaacggtgtatattattgtgcgaaagatcgggcagatttgactt

SEQ ID NO: 4416 - DNA, 50 bp, Homo sapiens
cggtgagactcagtgaaagccatcagcaaaactacagtaatgcggcacta

SEQ ID NO: 4417 - DNA, 50 bp, Homo sapiens
aagttaaacaagactctgaaagccctaaatcaactagtccgtcggctgca

SEQ ID NO: 4418 - DNA, 50 bp, Homo sapiens
cttgagtggtcctcttctgcctgctgctcatttgtcttgggcaaccattt

SEQ ID NO: 4419 - DNA, 50 bp, Homo sapiens
cccaggaatatacagtacttctgtagtgtccagccattacttagcaaggg

SEQ ID NO: 4420 - DNA, 50 bp, Homo sapiens
tgctctgtctgctggtttgcattgtttctgtctgagttaagagactggca

SEQ ID NO: 4421 - DNA, 50 bp, Homo sapiens
ttcttttctccgttagccacgcagctacctactcccgcttccggttcaaa

SEQ ID NO: 4422 - DNA, 50 bp, Homo sapiens; identical to SEQ ID NO: 846

SEQ ID NO: 4423 - DNA, 50 bp, Homo sapiens
gatgaacagtctgagaggcgaggacacggccttgtttaactgtgcgagtc

SEQ ID NO: 4424 - DNA, 50 bp, Homo sapiens
tactacttgccaggtccaagaacggggcgggtcctgttatcattattaca

SEQ ID NO: 4425 - DNA, 50 bp, Homo sapiens
gctgtgtttttctgtgggtgaaataaaggtttcggagcccgttttagata

SEQ ID NO: 4426 - DNA, 50 bp, Homo sapiens
catttctgtgcgagagtgaagaggggaccctagaggatttcgttgtggga

SEQ ID NO: 4427 - DNA, 50 bp, Homo sapiens
ggactccaggctgaggacgaggctgattattagtgatgctcataaacaag

SEQ ID NO: 4428 - DNA, 50 bp, Homo sapiens
ctcttattgtgcgagagacctcccggaactgccactgaaggtggaggcta

SEQ ID NO: 4429 - DNA, 50 bp, Homo sapiens
ctccctgactatctcgggcctctagcctgaggacgaggctgattattatt

SEQ ID NO: 4430 - DNA, 50 bp, Homo sapiens
aagaactcactgtatctgcaaatgaacagcctgaaaaccgaggacacggc

SEQ ID NO: 4431 - DNA, 50 bp, Homo sapiens
cacggctgtgtttaactctgcgacatgcgggggactatggttcgggggaa

SEQ ID NO: 4432 - DNA, 50 bp, Homo sapiens
tcagggtgattgaaggacacatattgaagtacctagaatgccagaaagtg

SEQ ID NO: 4433 - DNA, 50 bp, Homo sapiens
aacaaaactgtgatttatatcaaataacaatggcttggagggggtatgga

SEQ ID NO: 4434 - DNA, 50 bp, Homo sapiens; identical to SEQ ID NO: 1036

SEQ ID NO: 4435 - DNA, 50 bp, Homo sapiens; identical to SEQ ID NO: 1036

SEQ ID NO: 4436 - DNA, 50 bp, Homo sapiens; identical to SEQ ID NO: 1036

SEQ ID NO: 4437 - DNA, 50 bp, Homo sapiens
tgtggctgtacttaaccttctccaacatacatcctgcattacatgaatgg

SEQ ID NO: 4438 - DNA, 50 bp, Homo sapiens
aagcctttgaagtgcctctgattctatgtaacttgttgcagactggtgtt

SEQ ID NO: 4439 - DNA, 50 bp, Homo sapiens
gcattgacctggaaggagagaagatagagagtggaggctctgaaggagac

SEQ ID NO: 4440 - DNA, 50 bp, Homo sapiens
cagtacagggctggcaagcagtgatctctcaggtatatttatcaataatt

SEQ ID NO: 4441 - DNA, 50 bp, Homo sapiens
caaaccctcctttctgcttgcctcaaacctgccaaatatacccacacttt

SEQ ID NO: 4442 - DNA, 50 bp, Homo sapiens; identical to SEQ ID NO: 562

SEQ ID NO: 4443 - DNA, 50 bp, Homo sapiens
agtgatttgattaactcagggcaaggctgaatatcagagtgtatcgcact

SEQ ID NO: 4444 - DNA, 50 bp, Homo sapiens
gcttccactggaggcttgtattgaccttgtaactatatgttaatctcgtg

SEQ ID NO: 4445 - DNA, 50 bp, Homo sapiens
atgcatgtttaccaaaatggctgtttacagtgcattcagttctgatattt

SEQ ID NO: 4446 - DNA, 50 bp, Homo sapiens
acatgacaggtgtaattagtctgctgagccagctttacccaatgaagggc

SEQ ID NO: 4447 - DNA, 50 bp, Homo sapiens
aacagcaaccaataacggattgtaaagtgtaaaggcacaggttactcatg

SEQ ID NO: 4448 - DNA, 50 bp, Homo sapiens
ccatgccaaggaatggaatttccatcctgagccagttcagttaggtgtca

SEQ ID NO: 4449 - DNA, 50 bp, Homo sapiens
ctagagttcatctctgagctgtaagggtgaccagggggcagggggacgat

SEQ ID NO: 4450 - DNA, 50 bp, Homo sapiens
caagtagacaccagagtcactgtttggttggtgggtgatagtggggtcac

SEQ ID NO: 4451 - DNA, 50 bp, Homo sapiens
tgtcacccttccatgacgcctcctctgtgcatttgagttcactgtttatg

SEQ ID NO: 4452 - DNA, 50 bp, Homo sapiens
ggtaacatgagctatggcagtcggttgtgaaaccacaggaagtgtatggg

SEQ ID NO: 4453 - DNA, 50 bp, Homo sapiens
caaatcgggcaccacctccttcagggcgcatgagaccatattaaattcta

SEQ ID NO: 4454 - DNA, 50 bp, Homo sapiens
cagaactgctttcctatgtttacccaggggacctcctttcagatgaactg

SEQ ID NO: 4455 - DNA, 50 bp, Homo sapiens
agcaataatatctctgttttcatttcagaacattgtgctgtctgtcagca

SEQ ID NO: 4456 - DNA, 50 bp, Homo sapiens
ttacaactacatgatgggcatcgagtttaacccttggatcgggaagtggg

SEQ ID NO: 4457 - DNA, 50 bp, Homo sapiens
aatgtttgagctgaccaagcttctgagattcttaacagaaaaagccatgt

SEQ ID NO: 4458 - DNA, 50 bp, Homo sapiens
acgtcagcttaaaactggaaagaagtcttctggtgtatactgagatttga

SEQ ID NO: 4459 - DNA, 50 bp, Homo sapiens
gcccaaaggagtagctctctgttgttactgttgtgctcttcatggataaa

SEQ ID NO: 4460 - DNA, 50 bp, Homo sapiens
gcaaaaagcccaagagcctgaatttagaccaatctatcatcttcctcctc

SEQ ID NO: 4461 - DNA, 50 bp, Homo sapiens
tggagatgtgataacaactccttatctctttgttggctcatctgaagtgt

SEQ ID NO: 4462 - DNA, 50 bp, Homo sapiens
cttgcagtaaaatgtagcccttcctcctggttgtgcaggagtggccctcg

SEQ ID NO: 4463 - DNA, 50 bp, Homo sapiens
tttctttagcccaagagtggaggctaagctacttacttccaagcctgggt

SEQ ID NO: 4464 - DNA, 50 bp, Homo sapiens
aggcaaagggaacttgaaattagaaaaccccagaaacagtcacaatggct

SEQ ID NO: 4465 - DNA, 50 bp, Homo sapiens
agggtcccttccatagtcctcctgcatcattttcctccaacttgaataaa

SEQ ID NO: 4466 - DNA, 50 bp, Homo sapiens
gccaaccagttcagagtgttcccaaggaattgccacccttactcttcaaa

SEQ ID NO: 4467 - DNA, 50 bp, Homo sapiens
atcccagtctcaaatttcttcatttggaactgatatgtaggccctcatcg

SEQ ID NO: 4468 - DNA, 50 bp, Homo sapiens
tctctcactgttatcatttttgcacaggtggtttcagcagcttgatgcca

SEQ ID NO: 4469 - DNA, 50 bp, Homo sapiens
attgtcatttagactttgaacagctctgggaaatagaagactagggttgt

SEQ ID NO: 4470 - DNA, 50 bp, Homo sapiens; identical to SEQ ID NO: 293

SEQ ID NO: 4471 - DNA, 50 bp, Homo sapiens
ggattcaccgtggccgactcttttccctgctttggtttgtttgaaatcta

SEQ ID NO: 4472 - DNA, 50 bp, Homo sapiens
ccctccacaccatcctccccgatttaaatatagtcactgctacaagtaac

SEQ ID NO: 4473 - DNA, 50 bp, Homo sapiens
ttcatcattgcttgcttgccttcctcccttctgtccgctcttactccctc

SEQ ID NO: 4474 - DNA, 50 bp, Homo sapiens
gcaaactaaccgtgtcaacggggtgagatgttgcatcttataaaattaga

SEQ ID NO: 4475 - DNA, 50 bp, Homo sapiens; identical to SEQ ID NO: 4474

SEQ ID NO: 4476 - DNA, 50 bp, Homo sapiens; identical to SEQ ID NO: 4474

SEQ ID NO: 4477 - DNA, 50 bp, Homo sapiens
agtatctgctttccaggctgaagtgattcattcattattctagtcctgct

SEQ ID NO: 4478 - DNA, 50 bp, Homo sapiens
aagctgtcttctttgttggacaatcagccagaatgataagcaaacctgca

SEQ ID NO: 4479 - DNA, 50 bp, Homo sapiens
ctctcgcggtcgcacgaggatgcttggcacgtaccccctgtacatacttc

SEQ ID NO: 4480 - DNA, 50 bp, Homo sapiens; identical to SEQ ID NO: 4479

SEQ ID NO: 4481 - DNA, 50 bp, Homo sapiens; identical to SEQ ID NO: 4479

SEQ ID NO: 4482 - DNA, 50 bp, Homo sapiens
ctcctgtggattcacatcaaataccagttcagttttgtcattgttctagt

SEQ ID NO: 4483 - DNA, 50 bp, Homo sapiens
ggctcctgattacgatgctttggatgttgccaacaaaattgggatcatct

SEQ ID NO: 4484 - DNA, 50 bp, Homo sapiens
aacgccagcattttgttagaggagttagacttggaaaagttaagggaaga

SEQ ID NO: 4485 - DNA, 50 bp, Homo sapiens
atggggactaagggattaagagtgtgaactaaaaggtaacattttccact

SEQ ID NO: 4486 - DNA, 50 bp, Homo sapiens
actggcgagtatgttctatgttgggcctcctgctgcaaaacaataaacag

SEQ ID NO: 4487 - DNA, 50 bp, Homo sapiens
gctgattaactgtattcccctttcccctatggctgctggtgtaaataaac

SEQ ID NO: 4488 - DNA, 50 bp, Homo sapiens
cccagggtttcatgtctgaggccctcaccaagtgtgagtgacagtataaa

SEQ ID NO: 4489 - DNA, 50 bp, Homo sapiens; identical to SEQ ID NO: 4488

SEQ ID NO: 4490 - DNA, 50 bp, Homo sapiens; identical to SEQ ID NO: 4063

SEQ ID NO: 4491 - DNA, 50 bp, Homo sapiens
acacctctctattttgaagtccctatgtgccctgtaatgtctcgttttaa

SEQ ID NO: 4492 - DNA, 50 bp, Homo sapiens
gggagagctcatgtcagtgaatatagatcattctgttgatacccttcttt

SEQ ID NO: 4493 - DNA, 50 bp, Homo sapiens
ttgaaacttgtaactgagatgctgtagttttttgccatctgtagtgatgt

SEQ ID NO: 4494 - DNA, 50 bp, Homo sapiens
aaagggttttatccactgtcatttcaattggataacattttgtcaagttt

SEQ ID NO: 4495 - DNA, 50 bp, Homo sapiens
tcggaaagaagaagtgggaggatgtgaattttagttctgagtttaccaaa

SEQ ID NO: 4496 - DNA, 50 bp, Homo sapiens
gatcgggaactggctccgttgtgctgaggtcatctttggtcatcagcctc

SEQ ID NO: 4497 - DNA, 50 bp, Homo sapiens
tggtgcttgtgcagcctggcagttcattgtcatctttaataaactaagga

SEQ ID NO: 4498 - DNA, 50 bp, Homo sapiens
agaagtacaagatttcgttcttccttccattaaagtacaatctccctggg

SEQ ID NO: 4499 - DNA, 50 bp, Homo sapiens
tacaagtgaaagctaagatgaacacatttaagttaaatggcagccttgtt

SEQ ID NO: 4500 - DNA, 50 bp, Homo sapiens
aaaaggatgtgacagaagcagagatgaccagaaagcacaggggcagggtt

SEQ ID NO: 4501 - DNA, 50 bp, Homo sapiens
gggttttctataaggggtttcctgctgaacaggggcgtgggattgaatta

SEQ ID NO: 4502 - DNA, 50 bp, Homo sapiens
cctgggaccagggcatattaaaggcttttggcagcaaagtgtcagtgttg

SEQ ID NO: 4503 - DNA, 50 bp, Homo sapiens
tttgtggcttggggctgcctactataaactattgggggttcgtccatttt

SEQ ID NO: 4504 - DNA, 50 bp, Homo sapiens; identical to SEQ ID NO: 746

SEQ ID NO: 4505 - DNA, 50 bp, Homo sapiens
aattcctgaaccgttggatcaccttctgtcagtccatcatctccaccctg

SEQ ID NO: 4506 - DNA, 50 bp, Homo sapiens
cttacgttgggacacctaaattcgccgcgtctgtagaaggcagattcgag

SEQ ID NO: 4507 - DNA, 50 bp, Homo sapiens
aaaaccgtgtctgtcccttcaacagagtcatcgaggaggggtggctgcta

SEQ ID NO: 4508 - DNA, 50 bp, Homo sapiens
aaactgccgggtccccatcttcaaaagagaggaggccctttctccagctt

SEQ ID NO: 4509 - DNA, 50 bp, Homo sapiens
caagaaagcaacttgagccttgggctaatctggctgagtagtcagttata

SEQ ID NO: 4510 - DNA, 50 bp, Homo sapiens
tgtgttctttgagttccccctttacccaaaagtaatttggggaccaaagt

SEQ ID NO: 4511 - DNA, 50 bp, Homo sapiens
gggaaggcaatctgatggggaagttggcaatttctggtttgggtgattta

SEQ ID NO: 4512 - DNA, 50 bp, Homo sapiens
ccagccgtcctcctggggtggaccctagtttaataaagattcaccaagtt

SEQ ID NO: 4513 - DNA, 50 bp, Homo sapiens
catgcaagggcaaaaggcagtgccatgcaagctgtttaaaataaagatgt

SEQ ID NO: 4514 - DNA, 50 bp, Homo sapiens
aggggtgggaggaagcaaaagactctgtacctattttgtatgtgtataat

SEQ ID NO: 4515 - DNA, 50 bp, Homo sapiens
tcaggatgtgagcactcgttgtgtctggatgttacaaatatgggtggttt

SEQ ID NO: 4516 - DNA, 50 bp, Homo sapiens
tgttcacgttgttcacatcccatgtagaaaaacaaagatgccacggagga

SEQ ID NO: 4517 - DNA, 50 bp, Homo sapiens
agccctgcaaaaattcagagtccttgcaaaattgtctaaaatgtcagtgt

SEQ ID NO: 4518 - DNA, 50 bp, Homo sapiens
tgtcatctcaagtcaagtcactggtctgtttgcatttgatacatttttgt

SEQ ID NO: 4519 - DNA, 50 bp, Homo sapiens
gagtgaccacagggatgccacacagctcggatttcagcctctgatgtcag

SEQ ID NO: 4520 - DNA, 50 bp, Homo sapiens
gcctgttgccctttctgtaccatttatttgctcccaatgtttatgataat

SEQ ID NO: 4521 - DNA, 50 bp, Homo sapiens; identical to SEQ ID NO: 4520

SEQ ID NO: 4522 - DNA, 50 bp, Homo sapiens
tcctggatgcctctgaagagagggacagaccgtcagaaactggagagttt

SEQ ID NO: 4523 - DNA, 50 bp, Homo sapiens
acttaaccatataaatgtggaggctatcaacaaagaatgggcttgaaaca

SEQ ID NO: 4524 - DNA, 50 bp, Homo sapiens; identical to SEQ ID NO: 1933

SEQ ID NO: 4525 - DNA, 50 bp, Homo sapiens
aaacagacctaatgctccttgttcctagagtagagtggagggagggtggc

SEQ ID NO: 4526 - DNA, 50 bp, Homo sapiens
gagatagccttgctccggcccccttgaccttcagcaaatcacttctctcc

SEQ ID NO: 4527 - DNA, 50 bp, Homo sapiens
ctgctgcgtctcccttccaaactctggtgctgaataaacccttctgatct

SEQ ID NO: 4528 - DNA, 50 bp, Homo sapiens
cacttggctgcataaatgtggtacaaccattctgtcttgaagggcaggtg

SEQ ID NO: 4529 - DNA, 50 bp, Homo sapiens
cagccaatggacacagtagggcttggtgaatgctgctgagtgaatgagta

SEQ ID NO: 4530 - DNA, 50 bp, Homo sapiens
tgcagaggattgaggcttaattctgagctggccctttccagccaataaat

SEQ ID NO: 4531 - DNA, 50 bp, Homo sapiens
ttgaccttccactagaccatgagcacctgggcggaaagccatatatctta

SEQ ID NO: 4532 - DNA, 50 bp, Homo sapiens
acaagcagacacctgaaacaatcaacgcccaataaaacaaagtaggatga

SEQ ID NO: 4533 - DNA, 50 bp, Homo sapiens
tgaggaagaaagcattttgcatcagcctggagtgaaccatgaacttggat

SEQ ID NO: 4534 - DNA, 50 bp, Homo sapiens
ggaataaggtgttgcctggaatttctggtttgtaaggtggtcactgttct

SEQ ID NO: 4535 - DNA, 50 bp, Homo sapiens
tgaacagatggattaccttttgtcaaagcatcatctcaacactaacttga

SEQ ID NO: 4536 - DNA, 50 bp, Homo sapiens
cccagagttttcagggagtacacaggtagattagtttgaagcattgacct

SEQ ID NO: 4537 - DNA, 50 bp, Homo sapiens; identical to SEQ ID NO: 280

SEQ ID NO: 4538 - DNA, 50 bp, Homo sapiens
ggctgccccagaggacagtgggtggagtggtacctacttattaaatgtct

SEQ ID NO: 4539 - DNA, 50 bp, Homo sapiens
ccgagcaaagatcaaaataaaaagtgacacagcagcttcaccagagcatt

SEQ ID NO: 4540 - DNA, 50 bp, Homo sapiens
tttccttcaagcctagcccttctctcattatttctctctgaccctctccc

SEQ ID NO: 4541 - DNA, 50 bp, Homo sapiens
gggtcagtgttcaagaaggaaagcagttgttgaagctacagaagcccagg

SEQ ID NO: 4542 - DNA, 50 bp, Homo sapiens
tgaagactttccatatcaagagacatggtattgactcaacagtttccagt

SEQ ID NO: 4543 - DNA, 50 bp, Homo sapiens
ggactgtcattcagggaggctaaggagagaggcttgcttgggatatagaa

SEQ ID NO: 4544 - DNA, 50 bp, Homo sapiens
tcacttaaccccaggccattatcatatccagatggtcttcagagttgtct

SEQ ID NO: 4545 - DNA, 50 bp, Homo sapiens
ccactggatggtcatttggcatctccgtatatgtgctctggctcctcagc

SEQ ID NO: 4546 - DNA, 50 bp, Homo sapiens
ctgggccacactgaccctgatacaggcatggcagaagaatgggaatattt

SEQ ID NO: 4547 - DNA, 50 bp, Homo sapiens; identical to SEQ ID NO: 4546

SEQ ID NO: 4548 - DNA, 50 bp, Homo sapiens
tgatagcattggtcttgacaagcaccatagtgacactgaaatggattggt

SEQ ID NO: 4549 - DNA, 50 bp, Homo sapiens
ctgaggatgtagagagaacaggtgggctgtattcacgccattggttggaa

SEQ ID NO: 4550 - DNA, 50 bp, Homo sapiens; identical to SEQ ID NO: 2058

SEQ ID NO: 4551 - DNA, 50 bp, Homo sapiens
tggtccaaaggcaaagttcgggacaagctcaataacttagtcttgtttga

SEQ ID NO: 4552 - DNA, 50 bp, Homo sapiens
caacaggtgtcacactaaggagactttgttcatggctggggacacagccc

SEQ ID NO: 4553 - DNA, 50 bp, Homo sapiens
gcatggaaattcccttcatctggaaccatcagaaacaccctcacactggg

SEQ ID NO: 4554 - DNA, 50 bp, Homo sapiens
ggcagctatggtcaaattgagaaaggtagtgtataaatgtgacaaagaca

SEQ ID NO: 4555 - DNA, 50 bp, Homo sapiens
gctatcttgtctggttttcttgagacctcagatgtgtgttcagcagggct

SEQ ID NO: 4556 - DNA, 50 bp, Homo sapiens
ccgccctgtaccctctttcacctttccctaaagaccctaaatctgaggaa

SEQ ID NO: 4557 - DNA, 50 bp, Homo sapiens
catatgggagaaggccagtgcccaggcatagggttagctcagtttccctc

SEQ ID NO: 4558 - DNA, 50 bp, Homo sapiens
ttaataccaggaacccagcggctctagccactgagcggctaaatgaaata

SEQ ID NO: 4559 - DNA, 50 bp, Homo sapiens
gtggaggggtttaccaccttcctaggtcgttcaaccaggttttgtgagga

SEQ ID NO: 4560 - DNA, 50 bp, Homo sapiens
gcaacccttcagaaaggctttgctcctgctctcagatcagatcaagcatt

SEQ ID NO: 4561 - DNA, 50 bp, Homo sapiens
aacatttggaggaaggtgggaagcagatgactgaggaagggatggactaa

SEQ ID NO: 4562 - DNA, 50 bp, Homo sapiens
tgcccagaaagctcagaaggctaaatgaatattatccctaatacctgcca

SEQ ID NO: 4563 - DNA, 50 bp, Homo sapiens
agaggactcttcgagacattgagaccttctacaacacctccattgaggaa

SEQ ID NO: 4564 - DNA, 50 bp, Homo sapiens; identical to SEQ ID NO: 2128

SEQ ID NO: 4565 - DNA, 50 bp, Homo sapiens
aaactaaaacttcatcttccccaagtgcggggagtacaaggcatggcgta

SEQ ID NO: 4566 - DNA, 50 bp, Homo sapiens
aaaaccttcccataaaatgtaagaaaagctgatgaggctggtgacgttca

SEQ ID NO: 4567 - DNA, 50 bp, Homo sapiens; identical to SEQ ID NO: 641

SEQ ID NO: 4568 - DNA, 50 bp, Homo sapiens
gccacaaaatgttctttgttctttggctccaaaaagactgtcagctttca

SEQ ID NO: 4569 - DNA, 50 bp, Homo sapiens
ctgaggctctccctttctctgtgattggacagttgacagcacccaaactc

SEQ ID NO: 4570 - DNA, 50 bp, Homo sapiens
ccctgtaactcctcactgtactgatttactggcgcatgaaattctattaa

SEQ ID NO: 4571 - DNA, 50 bp, Homo sapiens
cttgagtaaaataaatattgtctttttgtatgtcaagcgggccgccaccg

SEQ ID NO: 4572 - DNA, 50 bp, Homo sapiens
gggagggagggagggaaagcttcctcctaaatcaagcatctttctgttac

SEQ ID NO: 4573 - DNA, 50 bp, Homo sapiens
tcacagatgcatatagacacacatacataatggtactcccaaactgacaa

SEQ ID NO: 4574 - DNA, 50 bp, Homo sapiens
gctgaggactcccgccatgtggccccaggtgccaccaataaaaatcctac

SEQ ID NO: 4575 - DNA, 50 bp, Homo sapiens
caagatgaggatttgggttttctataaggggtttcctgctggacaggggc

SEQ ID NO: 4576 - DNA, 50 bp, Homo sapiens
aaacatggcctttgcttgaaagaaaataccaaggaacaggaaactgatca

SEQ ID NO: 4577 - DNA, 50 bp, Homo sapiens; identical to SEQ ID NO: 52

SEQ ID NO: 4578 - DNA, 50 bp, Homo sapiens
ggaccaaaggctgattcttggagatttaactccccacaggcaatgggttt

SEQ ID NO: 4579 - DNA, 50 bp, Homo sapiens
aatatttgtttaatccccagttcgcctggagccctccgccttcacattcc

SEQ ID NO: 4580 - DNA, 50 bp, Homo sapiens
aaagtaactggttgtcacctatgagacccttacgtgattgttagttaagt

SEQ ID NO: 4581 - DNA, 50 bp, Homo sapiens
ctcagcctcctcatctgggggagtggaatagtatcctccaggtttttcaa

SEQ ID NO: 4582 - DNA, 50 bp, Homo sapiens
ggcaggaggttctcactgttgtgaaggttgtagacgttgtgtaatgtgtt

SEQ ID NO: 4583 - DNA, 50 bp, Homo sapiens
aagtgggaattttctggaagatggtcagctatgaagtaatagagtttgct

SEQ ID NO: 4584 - DNA, 50 bp, Homo sapiens
gcctgtggcccacctggggtcacttggaaaggatctgaataaaggggacc

SEQ ID NO: 4585 - DNA, 50 bp, Homo sapiens
aaataactggctcccagggtggcggtggtggcagcagtgatcctctgaac

SEQ ID NO: 4586 - DNA, 50 bp, Homo sapiens
tgcccacacccacactctccagcatctggcacaataaacattctctgttt

SEQ ID NO: 4587 - DNA, 50 bp, Homo sapiens; identical to SEQ ID NO: 4586

SEQ ID NO: 4588 - DNA, 50 bp, Homo sapiens
gcacccacctttctgcacataagttatggttttccatcttatctgtcttc

SEQ ID NO: 4589 - DNA, 50 bp, Homo sapiens
aattgtcaaacacagcttgcaatatacatagaaacgtctgtgctcaagga

SEQ ID NO: 4590 - DNA, 50 bp, Homo sapiens
tccagaaacatgacaaggaggactttcctgcctcttggagatcagaggag

SEQ ID NO: 4591 - DNA, 50 bp, Homo sapiens
tcatagttaaatttggtattcgtgggggaagaaatgaccatttcccttgt

SEQ ID NO: 4592 - DNA, 50 bp, Homo sapiens
acacacattcttgctctacccaaagctctggctggcagcactaaatgctt

SEQ ID NO: 4593 - DNA, 50 bp, Homo sapiens; identical to SEQ ID NO: 4592

SEQ ID NO: 4594 - DNA, 50 bp, Homo sapiens
gcagtctccacagtcttcagaagacaaatgctcaggtagtcactgtttcc

SEQ ID NO: 4595 - DNA, 50 bp, Homo sapiens
gcctcccgtgcatctgtactcaccctgtacgacaaacacattacattatt

SEQ ID NO: 4596 - DNA, 50 bp, Homo sapiens
tttcctgttccagaaaaggggctgggatgtctccgtctctgtctcaaatt

SEQ ID NO: 4597 - DNA, 50 bp, Homo sapiens
cggccttctccggtgtcctgtaccaactcttctatttaagagaacctcag

SEQ ID NO: 4598 - DNA, 50 bp, Homo sapiens
gggacgttccatgcccaggttaacaaagaactgtgatatatagagtgtct

SEQ ID NO: 4599 - DNA, 50 bp, Homo sapiens
atgggagatgcctgtgtaatttcgtccgaagctgccaggaagaagaacag

SEQ ID NO: 4600 - DNA, 50 bp, Homo sapiens
cctctccattgaaggattcaggaagaagaaaactcaactcagtgccattt

SEQ ID NO: 4601 - DNA, 50 bp, Homo sapiens
cctcaccttggcaccagacacccaggacttatttaaactctgttgcaagt

SEQ ID NO: 4602 - DNA, 50 bp, Homo sapiens
tgcaaatgtgagtttcctctcctgtccgtgtttgtttagtacttttataa

SEQ ID NO: 4603 - DNA, 50 bp, Homo sapiens
agcaggaattggtggcagattttacaaaagatgtatccttccaatttgga

SEQ ID NO: 4604 - DNA, 50 bp, Homo sapiens
tggatctgccaaaaagaactaacacctgtgagaaataaagtgtatcctga

SEQ ID NO: 4605 - DNA, 50 bp, Homo sapiens
ttcctgtactattgtgttttgagtgtgttttggaaccttcatagaacaca

SEQ ID NO: 4606 - DNA, 50 bp, Homo sapiens
tgacccacttaccttgcatctcacaggtagacagtatataactaacaacc

SEQ ID NO: 4607 - DNA, 50 bp, Homo sapiens; identical to SEQ ID NO: 2312

SEQ ID NO: 4608 - DNA, 50 bp, Homo sapiens
cacgagagtgaagagtgagccagcccttctggagcaggagcaggacagaa

SEQ ID NO: 4609 - DNA, 50 bp, Homo sapiens
aagaaaggcacaaaatgtgctatttttggtcacttgctttatgacgttta

SEQ ID NO: 4610 - DNA, 50 bp, Homo sapiens
gtccctggacacagctcttcattccattgacttagaggcaacaggattga

SEQ ID NO: 4611 - DNA, 50 bp, Homo sapiens
gtaccagctctccaacacggaggcaatcgactgcatcacgcagggacgtg

SEQ ID NO: 4612 - DNA, 50 bp, Homo sapiens
gggggctagttctctcctcacttgtaaacttgtgtagtttcacagaaaaa

SEQ ID NO: 4613 - DNA, 50 bp, Homo sapiens
acagaagaatttgtgtggaagcaggatgtaacagatacaccgtaaaggca

SEQ ID NO: 4614 - DNA, 50 bp, Homo sapiens; identical to SEQ ID NO: 2339

SEQ ID NO: 4615 - DNA, 50 bp, Homo sapiens
cttgaaggaagagggaccagggtgggagagctgattgcagaaaggagaga

SEQ ID NO: 4616 - DNA, 50 bp, Homo sapiens
aaaccattaaagtatacagagaggatgacacagccacagaagaaactcat

SEQ ID NO: 4617 - DNA, 50 bp, Homo sapiens
aacatgcacaaagcagttaattaggcagcctggagaaaaccagagatcca

SEQ ID NO: 4618 - DNA, 50 bp, Homo sapiens
acttccagaaactcatcaaatgaacagacaatgtcaaaactactgtgtct

SEQ ID NO: 4619 - DNA, 50 bp, Homo sapiens
gctttatgggtttggcttgtttttcttgcatggtttggagctgatcgctt

SEQ ID NO: 4620 - DNA, 50 bp, Homo sapiens
ttctttcttggcctcaagttcaatatggagaggattgcttccctgaatcc

SEQ ID NO: 4621 - DNA, 50 bp, Homo sapiens
aactatgtggactggattaaggacaccatagctgccaacagctaaagccc

SEQ ID NO: 4622 - DNA, 50 bp, Homo sapiens
cctgacttcttcacgcgggtagccctctacgtggactggatccgttctac

SEQ ID NO: 4623 - DNA, 50 bp, Homo sapiens
agccagcaggacatgaagttgctattaaatggacttcgtgatttttgttt

SEQ ID NO: 4624 - DNA, 50 bp, Homo sapiens; identical to SEQ ID NO: 2383

SEQ ID NO: 4625 - DNA, 50 bp, Homo sapiens
aacttgtgccacaagagttacaatcaaagtggtctccttagactgaattc

SEQ ID NO: 4626 - DNA, 50 bp, Homo sapiens
aaagcctttaaaaacggctgtcaggtttgatctcagtgtaacaacatggc

SEQ ID NO: 4627 - DNA, 50 bp, Homo sapiens
gaaaatgcgccttaggctgagccaacatgactgtcccccaaactccagtg

SEQ ID NO: 4628 - DNA, 50 bp, Homo sapiens
ccagcttcggttccttccacctcatccggctgctctacgacgagtacatg

SEQ ID NO: 4629 - DNA, 50 bp, Homo sapiens
aagattggtgctcctgataaagcaaagggctaggaatacaatggaaagga

SEQ ID NO: 4630 - DNA, 50 bp, Homo sapiens
tcattggtacacattctgtatgctgctgttttcaagttggcaaattaagc

SEQ ID NO: 4631 - DNA, 50 bp, Homo sapiens
tatcagcaactgtcctcatcagtctccataccccttcagctttcctgagc

SEQ ID NO: 4632 - DNA, 50 bp, Homo sapiens
gcagcttggagaaggcgcaatactccagctccaccgttaccgctaatata

SEQ ID NO: 4633 - DNA, 50 bp, Homo sapiens; identical to SEQ ID NO: 4632

SEQ ID NO: 4634 - DNA, 50 bp, Homo sapiens
cggagcctcaaacaagcattataccttctgtgattatgatttcctctcct

SEQ ID NO: 4635 - DNA, 50 bp, Homo sapiens
atgtttcttggggaatatgttagagaattcccttactcttgattgtggga

SEQ ID NO: 4636 - DNA, 50 bp, Homo sapiens
agagtgatagtcttttgcttttggcaaaactctacttaatccaatgggtt

SEQ ID NO: 4637 - DNA, 50 bp, Homo sapiens
gcctcttgcttggcgtgataaccctgtcatcttcccaaagctcatttatg

SEQ ID NO: 4638 - DNA, 50 bp, Homo sapiens
ttcaactgaccagtcgtggttactccctgctgccaggtccttccccttcc

SEQ ID NO: 4639 - DNA, 50 bp, Homo sapiens
ggctggcacctctcaacgtctgtggactgaatgaataaaccctcctcatc

SEQ ID NO: 4640 - DNA, 50 bp, Homo sapiens
tgggaataacgtccaaaacactctggatcttatatggagaatgacattga

SEQ ID NO: 4641 - DNA, 50 bp, Homo sapiens
agtactgaactcagttccatccgtaaaatatgtaaaggtaagtggcagct

SEQ ID NO: 4642 - DNA, 50 bp, Homo sapiens
gcccaacttcatttccatacttcagggaacagcaaattgaggatttactt

SEQ ID NO: 4643 - DNA, 50 bp, Homo sapiens
ccgttgaatgagtgtgttttgtacataacttcagatacttgtgaacatgc

SEQ ID NO: 4644 - DNA, 50 bp, Homo sapiens
tttcttgggagagtcactccagccctgaagtctgtctctagctcctctgt

SEQ ID NO: 4645 - DNA, 50 bp, Homo sapiens; identical to SEQ ID NO: 2514

SEQ ID NO: 4646 - DNA, 50 bp, Homo sapiens
ttaggagtgattactaattatcaagggcacagttgtggtactgtcattga

SEQ ID NO: 4647 - DNA, 50 bp, Homo sapiens
cggacggaaggacggaaaaagctctatttttatgttaggcttatttcatg

SEQ ID NO: 4648 - DNA, 50 bp, Homo sapiens
agtccctgacagcctagaaataagctgtttgtcttctataaagcattgct

SEQ ID NO: 4649 - DNA, 50 bp, Homo sapiens
gcattttctgcctatgctggaatagctccctcttctggtcctggctcagg

SEQ ID NO: 4650 - DNA, 50 bp, Homo sapiens
agtaagggcacgtagagcatttagagttgtctttcagcattcaatcaggc

SEQ ID NO: 4651 - DNA, 50 bp, Homo sapiens
tgggtcttcagccttacccggaaatacttgtggtttctagatcaccatct

SEQ ID NO: 4652 - DNA, 50 bp, Homo sapiens
acaaggctgacaccaacagagatcgtattgatattgccaatgccagagca

SEQ ID NO: 4653 - DNA, 50 bp, Homo sapiens
agctacttctgccttatggctagggaactgtcatgtctaccatgtattgt

SEQ ID NO: 4654 - DNA, 50 bp, Homo sapiens
tgacttgttttgctccatgtctcctcattcctacacctattttctgctgc

SEQ ID NO: 4655 - DNA, 50 bp, Homo sapiens
ctgtgaaaccgtcagttcggaaggctggttagaacatgtgggagcaacat

SEQ ID NO: 4656 - DNA, 50 bp, Homo sapiens
gcctagtgtgtgtgctttcttaatgtgtgtgccaatggtggatctttgct

SEQ ID NO: 4657 - DNA, 50 bp, Homo sapiens
accaaactggactctcgtgcagaaaatgtagcccattaccacatgtagcc

SEQ ID NO: 4658 - DNA, 50 bp, Homo sapiens; identical to SEQ ID NO: 2585

SEQ ID NO: 4659 - DNA, 50 bp, Homo sapiens; identical to SEQ ID NO: 4482

SEQ ID NO: 4660 - DNA, 50 bp, Homo sapiens
gccaacagaacagaagaaaatgtttcagacggttccccaaatgccggttc

SEQ ID NO: 4661 - DNA, 50 bp, Homo sapiens
ctctagaaaggcccaagtccatgagcacagagggtctgatgaagtttgtg

SEQ ID NO: 4662 - DNA, 50 bp, Homo sapiens
agaccaagaggatattcctcaaagcagaaagtgaagaagaaatttttgcg

SEQ ID NO: 4663 - DNA, 50 bp, Homo sapiens
tggagaagttccagtcctgtctgagccctgaagagccagctcccgaatcc

SEQ ID NO: 4664 - DNA, 50 bp, Homo sapiens
gaagtagactttctgtcctcacaccgaagaacccgagtgagcaggaggga

SEQ ID NO: 4665 - DNA, 50 bp, Homo sapiens
gtgggatttctggggaggctggtgaaggagggcagggttcttttctctac

SEQ ID NO: 4666 - DNA, 50 bp, Homo sapiens
ctatagcttcatgaccgtaacatgtgacctgtgtgctggcaggacgactc

SEQ ID NO: 4667 - DNA, 50 bp, Homo sapiens
atgatccccatgttgcaatatggagtctctgccctgagatcttccccatc

SEQ ID NO: 4668 - DNA, 50 bp, Homo sapiens
tggtcagtctttgttctctgagaaattatgttggaagcagcatactttca

SEQ ID NO: 4669 - DNA, 50 bp, Homo sapiens
ccccaagatacacactggaccctctcttgctgaatgtgggcattaatttt

SEQ ID NO: 4670 - DNA, 50 bp, Homo sapiens
ttctaacacgtcgccttcaactgtaatcacaacatcctgactccgtcatt

SEQ ID NO: 4671 - DNA, 50 bp, Homo sapiens
tttttcattttggagctagttactgggagtaagggagggtggggtggggg

SEQ ID NO: 4672 - DNA, 50 bp, Homo sapiens
gggactgtcttttctgtattcgctgttcaataaacattgagtgagcacct

SEQ ID NO: 4673 - DNA, 50 bp, Homo sapiens; identical to SEQ ID NO: 4672

SEQ ID NO: 4674 - DNA, 50 bp, Homo sapiens
agagaagactcatcttcactatcggcacgtccaacaccacgggcgagtcg

SEQ ID NO: 4675 - DNA, 50 bp, Homo sapiens
aaaccgaaatattgaaatggtgtaatgttgtaccatttgcactgtgagca

SEQ ID NO: 4676 - DNA, 50 bp, Homo sapiens
aggtgggggaaaatgaattttgtatgctgaatttctaagcgcctattgtt

SEQ ID NO: 4677 - DNA, 50 bp, Homo sapiens
gtggatgtggagcaggagagctggatcgtggcatttgtttctgggttctg

SEQ ID NO: 4678 - DNA, 50 bp, Homo sapiens; identical to SEQ ID NO: 1767

SEQ ID NO: 4679 - DNA, 50 bp, Homo sapiens
tgtggttgcctctatgtgctgtttttcctcatacaagtaaacacagaaag

SEQ ID NO: 4680 - DNA, 50 bp, Homo sapiens
cccaactgaggaccactgtctacagagtcaggaaatattgtagggagaaa

SEQ ID NO: 4681 - DNA, 50 bp, Homo sapiens
tgtttgtttctttgtgttgactttgtccctggcaaaattttccactctga

SEQ ID NO: 4682 - DNA, 50 bp, Homo sapiens
aggtgacctggttacttagctaggattggtgatttgtactgctttatggt

SEQ ID NO: 4683 - DNA, 50 bp, Homo sapiens
ccctacccttgccctttaacttattgggactgaataaagaatggagaggc

SEQ ID NO: 4684 - DNA, 50 bp, Homo sapiens
gggcttttgctctggtgtattttattgtcagaaagtccagactcaagagt

SEQ ID NO: 4685 - DNA, 50 bp, Homo sapiens
tggtctgactgtgctatggcctcatcatcaagactttcaatcctatccca

SEQ ID NO: 4686 - DNA, 50 bp, Homo sapiens
gggcgaggcaggccgactgtactaaagtaacgcaataaacgcattatcag

SEQ ID NO: 4687 - DNA, 50 bp, Homo sapiens
gtacgccgctacctggacagcgcgatgcaggagaaagagttcaaatacac

SEQ ID NO: 4688 - DNA, 50 bp, Homo sapiens; identical to SEQ ID NO: 2679

SEQ ID NO: 4689 - DNA, 50 bp, Homo sapiens; identical to SEQ ID NO: 844

SEQ ID NO: 4690 - DNA, 50 bp, Homo sapiens
tgagcttgctcttacgttttaagaggtgccaggggtacatttttgcactg

SEQ ID NO: 4691 - DNA, 50 bp, Homo sapiens
actggacaactttgagtactgacatcattgataaataaactggcttgtgg

SEQ ID NO: 4692 - DNA, 50 bp, Homo sapiens
cgcagggtctacgaagaatagggtgaaaaacctcagaagggaaaactcca

SEQ ID NO: 4693 - DNA, 50 bp, Homo sapiens
aggttttgtctggttgcatataatctttgctctttttaagctctgtgagc

SEQ ID NO: 4694 - DNA, 50 bp, Homo sapiens
ccttgcagaccccaccccctgcctgctctctttccctacaactaggtcag

SEQ ID NO: 4695 - DNA, 50 bp, Homo sapiens; identical to SEQ ID NO: 2719

SEQ ID NO: 4696 - DNA, 50 bp, Homo sapiens
ggagttgcactctgggtgggaagcactcaaataaagatgcgtggtgttaa

SEQ ID NO: 4697 - DNA, 50 bp, Homo sapiens
agcttttgaaaagtggaaaggtcattttgttgcatttccccatttcttgt

SEQ ID NO: 4698 - DNA, 50 bp, Homo sapiens
acctccttattgaagggaagagggaccagcacatgaggctgaggctgagg

SEQ ID NO: 4699 - DNA, 50 bp, Homo sapiens
ggtatctcccacacagcctggcactccaaccgtaccctttatgagacctg

SEQ ID NO: 4700 - DNA, 50 bp, Homo sapiens
aaggatggtcacacaccagcactttatacacttctggctcacaggaaagt

SEQ ID NO: 4701 - DNA, 50 bp, Homo sapiens
atcatcctgccagcagcactcctcccgttcctccagcgtagactacattt

SEQ ID NO: 4702 - DNA, 50 bp, Homo sapiens
agtgctacactcgtctccactgtttgttttacttccccaaaatggacctt

SEQ ID NO: 4703 - DNA, 50 bp, Homo sapiens
acgctactattacgacaaaaacatcatccacaagacagcggggaaacgct

SEQ ID NO: 4704 - DNA, 50 bp, Homo sapiens
tttgagagggtaggagggtgggaaggaaacaaccatgtcatttcagaagt

SEQ ID NO: 4705 - DNA, 50 bp, Homo sapiens
catgctcagtatcattgtggagaaccaagagggcctcttaactgtaacaa

SEQ ID NO: 4706 - DNA, 50 bp, Homo sapiens
gaccggcttcccctgtgagcagcagagcagcacaataaatgaggccactg

SEQ ID NO: 4707 - DNA, 50 bp, Homo sapiens
gaagataccaacctgtgtgccatccacgctaagagagtcaccatcatgcc

SEQ ID NO: 4708 - DNA, 50 bp, Homo sapiens
gttatcactctgcctgtgtatagtcagatagtccatgcgaaggctgtata

SEQ ID NO: 4709 - DNA, 50 bp, Homo sapiens; identical to SEQ ID NO: 2764

SEQ ID NO: 4710 - DNA, 50 bp, Homo sapiens
taagccagcactcacaccactaacatgccctgttcagctactcccactcc

SEQ ID NO: 4711 - DNA, 50 bp, Homo sapiens
ggatgttttctagttgtgcatgaatgctggcaacttagtaagttttgaca

SEQ ID NO: 4712 - DNA, 50 bp, Homo sapiens
cccaaatagtaatgctttagagggaggcagtcatatctctgtgtgcagat

SEQ ID NO: 4713 - DNA, 50 bp, Homo sapiens; identical to SEQ ID NO: 2779

SEQ ID NO: 4714 - DNA, 50 bp, Homo sapiens
ccccttcctcacactgacctgtgttccttccctgttctcttttctattaa

SEQ ID NO: 4715 - DNA, 50 bp, Homo sapiens
aaactctaccaaggaggatgcactgggcctgcctgcggaacagggtatgt

SEQ ID NO: 4716 - DNA, 50 bp, Homo sapiens
cccttggcacgtaaacagactactagacttattgtaggttcgtttgagct

SEQ ID NO: 4717 - DNA, 50 bp, Homo sapiens
caaaggccagccagcttgggagcagcagagaaataaacagcatttctgat

SEQ ID NO: 4718 - DNA, 50 bp, Homo sapiens
gtgagatcggtgcgttctcctgatgttttgccgtggcttggggattgtac

SEQ ID NO: 4719 - DNA, 50 bp, Homo sapiens
gaactttcaggaagaagcatgttttattctggacacaatgaaagaaacca

SEQ ID NO: 4720 - DNA, 50 bp, Homo sapiens
ttgggtgtagatttctgacatcaaaacttggacccttggaaaacaaaagt

SEQ ID NO: 4721 - DNA, 50 bp, Homo sapiens
caacccagcttccctctgctgtgccacggctgttgcttcggttatttaaa

SEQ ID NO: 4722 - DNA, 50 bp, Homo sapiens; identical to SEQ ID NO: 2827

SEQ ID NO: 4723 - DNA, 50 bp, Homo sapiens
acatgagcttctacctccagatgtgccagggtgcatctcaataaacttgg

SEQ ID NO: 4724 - DNA, 50 bp, Homo sapiens
actgaaaagacaactggctacaaagaaggatgtcagaatgtaaggaaact

SEQ ID NO: 4725 - DNA, 50 bp, Homo sapiens
aagttgtggctgttcttgggaaaggggtcaccgtgtctgacaaagtgtaa

SEQ ID NO: 4726 - DNA, 50 bp, Homo sapiens
cccctcgccccgtcacaccgttatgcattactctgtgtctactattatgt

SEQ ID NO: 4727 - DNA, 50 bp, Homo sapiens
gctgtgagagcttgtttctgattgtttcattgttcgcttctgtaattctg

SEQ ID NO: 4728 - DNA, 50 bp, Homo sapiens; identical to SEQ ID NO: 2863

SEQ ID NO: 4729 - DNA, 50 bp, Homo sapiens
tgctcagtttttcagctcctctccactctgctttcccaaatggattctgt

SEQ ID NO: 4730 - DNA, 50 bp, Homo sapiens
atattcactaccaaaagaggcaagaaagtctgtacccatccaaggaaaaa

SEQ ID NO: 4731 - DNA, 50 bp, Homo sapiens
gctgcattacctctagaaacctcaaacaagtagaaacttgcctagacaat

SEQ ID NO: 4732 - DNA, 50 bp, Homo sapiens
tccaagtcgaaatcgctgctgaggctgagatgaagaaagaaaagtccaaa

SEQ ID NO: 4733 - DNA, 50 bp, Homo sapiens
catctcctcccagaacgtcacagtgctcagagacaaactggtcaagtgtg

SEQ ID NO: 4734 - DNA, 50 bp, Homo sapiens
tttgtctgcacttgagttcacttgagtttacatttgaaatgtgcatgttt

SEQ ID NO: 4735 - DNA, 50 bp, Homo sapiens
agttccctttatttcacataagcccaaactgatagacagtaacggtgttt

SEQ ID NO: 4736 - DNA, 50 bp, Homo sapiens
ggagagggtgggacccagttttgcgtggttggtttttattaattatctgg

SEQ ID NO: 4737 - DNA, 50 bp, Homo sapiens
cctctttccctctgtctgtgcttgtgttgttgacctcctgatggcttgtc

SEQ ID NO: 4738 - DNA, 50 bp, Homo sapiens
ctgattcttctgtcctcattgtgaacataaccgtgtagttgaaacagtca

SEQ ID NO: 4739 - DNA, 50 bp, Homo sapiens
tttccaatgtctgccacacaaacgtatgtaaatgtatatacccacacaca

SEQ ID NO: 4740 - DNA, 50 bp, Homo sapiens
tcctgagaaacaacacatttttccccatgaacggtgctgttctgaagtct

SEQ ID NO: 4741 - DNA, 50 bp, Homo sapiens
tattgccaccatccaactcattgagtcttatggttcacatcttgtttcct

SEQ ID NO: 4742 - DNA, 50 bp, Homo sapiens
agtcctatggttcacatcttgtttcctatagaaatgtcctgtattctggg

SEQ ID NO: 4743 - DNA, 50 bp, Homo sapiens
aaaccaggaagaaaaggtatttctttaaatccagaacaatggagccagct

SEQ ID NO: 4744 - DNA, 50 bp, Homo sapiens
aagcagttggactttcacagcagcaaggaattatcttcaagcacagagga

SEQ ID NO: 4745 - DNA, 50 bp, Homo sapiens
cttcagtgtagctctctcctcttcaaataaacatgtctgccctcatggtt

SEQ ID NO: 4746 - DNA, 50 bp, Homo sapiens
ttctctcgtgcaaccagtttgcccattctcttcctattacttgctccagg

SEQ ID NO: 4747 - DNA, 50 bp, Homo sapiens
tgctcttcagaagtttcaccctttttaatctctcagccacaaacctcagt

SEQ ID NO: 4748 - DNA, 50 bp, Homo sapiens
acgtttactggtactgctttctaaatactgttttacccgttttctcttgt

SEQ ID NO: 4749 - DNA, 50 bp, Homo sapiens
gacaaccaattcaaatgattgtgctaacttatttcccctagttgacctgt

SEQ ID NO: 4750 - DNA, 50 bp, Homo sapiens
ggccaagcccagcttaatggctcatgacctggaaataaaatttaggacca

SEQ ID NO: 4751 - DNA, 50 bp, Homo sapiens
ctcaagacagtgtttgacgaagcgatccgagcagtcctctgcccgcctcc

SEQ ID NO: 4752 - DNA, 50 bp, Homo sapiens
ctttttcaccaccgtcttcaatgcccatgagcctttccgccggggtacag

SEQ ID NO: 4753 - DNA, 50 bp, Homo sapiens
acatcgtatttgcggccagcctctacacccagtgaatgccccatgtaaaa

SEQ ID NO: 4754 - DNA, 50 bp, Homo sapiens
tattccttttatatcactgtgtttgaatcgagggggaggggtggtaaccg

SEQ ID NO: 4755 - DNA, 50 bp, Homo sapiens
atgggaatagttgcatatgggaatttaaaccaacatgtggctgagccttt

SEQ ID NO: 4756 - DNA, 50 bp, Homo sapiens
ggcctttgaatgtaaagctgcataagctgttaggttttgttttaaaagga

SEQ ID NO: 4757 - DNA, 50 bp, Homo sapiens
cagtttggccttatgctttatgcagacttgagtgtatgcaggatttcatt

SEQ ID NO: 4758 - DNA, 50 bp, Homo sapiens
cagaccaagagcaccacagactacaactgcccagcttcatctaaatactt

SEQ ID NO: 4759 - DNA, 50 bp, Homo sapiens
gtgggtaaggggctcaagctgtgatgctgctggttttatctctagtgaaa

SEQ ID NO: 4760 - DNA, 50 bp, Homo sapiens
accctcccaggttcctgctgagatatttctcacaatcagacaagagccag

SEQ ID NO: 4761 - DNA, 50 bp, Homo sapiens
gggcagagaaggtggagagtaaagacccaacattactaacaatgatacag

SEQ ID NO: 4762 - DNA, 50 bp, Homo sapiens; identical to SEQ ID NO: 3039

SEQ ID NO: 4763 - DNA, 50 bp, Homo sapiens
aacacatttgaggaataggaggtccgggttttccataatgggtaaaatgg

SEQ ID NO: 4764 - DNA, 50 bp, Homo sapiens
gctgttccacctcccttcagactatctttcagccttctgccagcagtaaa

SEQ ID NO: 4765 - DNA, 50 bp, Homo sapiens
actataagtcattttgagtgttggtgttaagcatgaaacaaacagcagct

SEQ ID NO: 4766 - DNA, 50 bp, Homo sapiens
gctattcacagttctggggaacaaccaaaggaggaggaggacaaagggaa

SEQ ID NO: 4767 - DNA, 50 bp, Homo sapiens; identical to SEQ ID NO: 1116

SEQ ID NO: 4768 - DNA, 50 bp, Homo sapiens
ctatccacagaagctggccttcgccgagtgcctgtgcagaggctgtatcg

SEQ ID NO: 4769 - DNA, 50 bp, Homo sapiens
gtcatatagtccatgtctgtgatgtgagccaagtgatatcctgtagtaca

SEQ ID NO: 4770 - DNA, 50 bp, Homo sapiens
tccactgggtgaatcctccctctcagaaccaataaaatagaattgacctt

SEQ ID NO: 4771 - DNA, 50 bp, Homo sapiens
gagtttctctatcgcattggtcaaccaaaagagacgcattccattgggcg

SEQ ID NO: 4772 - DNA, 50 bp, Homo sapiens; identical to SEQ ID NO: 183

SEQ ID NO: 4773 - DNA, 50 bp, Homo sapiens
tgcgaaattgtggactgttggactgtgattctaagtgggggaaataggct

SEQ ID NO: 4774 - DNA, 50 bp, Homo sapiens
gaacctttctgaaaccagtggcagcccaagttagagcccagcattaagtc

SEQ ID NO: 4775 - DNA, 50 bp, Homo sapiens
ccagaatcttctattcccacttcccatttctcaaatcatttgacctgtcg

SEQ ID NO: 4776 - DNA, 50 bp, Homo sapiens
cctcctggctgtggtggtctttattcacggctactatgcctgaactctat

SEQ ID NO: 4777 - DNA, 50 bp, Homo sapiens
gaaattaagcgatacgaatcccagcttcgggatcttgagcggcagtcaga

SEQ ID NO: 4778 - DNA, 50 bp, Homo sapiens
tcacagtgaccactacagagtactaagaagagaagatcaagggcatgaaa

SEQ ID NO: 4779 - DNA, 50 bp, Homo sapiens
tcttaaagccagaaataatggaggagattgtgatggaaacacgccagagg

SEQ ID NO: 4780 - DNA, 50 bp, Homo sapiens
cttttctttgtgcagcggtctggttatcgtctatccccaggggaatccac

SEQ ID NO: 4781 - DNA, 50 bp, Homo sapiens
ccacgttggggtcactactggagtggatggaggcccttcacatttctggg

SEQ ID NO: 4782 - DNA, 50 bp, Homo sapiens
tgacctttcgtgattatccgcaaatgcaaacagtttcagatctaatggtt

SEQ ID NO: 4783 - DNA, 50 bp, Homo sapiens
cagtcatggagaccatcgctgtgggctgcacctgcatcttctgaatcacc

SEQ ID NO: 4784 - DNA, 50 bp, Homo sapiens
aggtttcttcatgagtcattccaagttttctagtccataccacagtgcct

SEQ ID NO: 4785 - DNA, 50 bp, Homo sapiens
gaggtcgtcttaaaccagagagctactgaatataagaactcttgcagtct

SEQ ID NO: 4786 - DNA, 50 bp, Homo sapiens
gcagtctcccaaggacccaccatgcagaagtgtcaataaaccacaagttc

SEQ ID NO: 4787 - DNA, 50 bp, Homo sapiens
ggagggagcctctgtgcagatgtgctttctttacagtggctgtaaaaagt

SEQ ID NO: 4788 - DNA, 50 bp, Homo sapiens
gatgcttttaaagttgtagcttcgtgctttgtacagttttctttctggtt

SEQ ID NO: 4789 - DNA, 50 bp, Homo sapiens
aatatatgcaattctccctcccccagcccttccctgacccctaagttatt

SEQ ID NO: 4790 - DNA, 50 bp, Homo sapiens
aatctgccaggctatgtgacagtaggaaggaatggtttcccctaacaagc

SEQ ID NO: 4791 - DNA, 50 bp, Homo sapiens
agcacatacattgatagatggggtgtgggaccaacaaaccaaattaaaag

SEQ ID NO: 4792 - DNA, 50 bp, Homo sapiens; identical to SEQ ID NO: 3240

SEQ ID NO: 4793 - DNA, 50 bp, Homo sapiens
ttgtggaaactgtttcagcaaaggttcttgtatagagggaatagggaatt

SEQ ID NO: 4794 - DNA, 50 bp, Homo sapiens
gggggaaggaaggcttcagacttgggggaaggggagattattgcaaattg

SEQ ID NO: 4795 - DNA, 50 bp, Homo sapiens
ctatggaggaattgagggcaagcacccaggactgatgaggtcttaacaaa

SEQ ID NO: 4796 - DNA, 50 bp, Homo sapiens
acaccaaacagttaagtccattctctggtactagctacaaattcggtttc

SEQ ID NO: 4797 - DNA, 50 bp, Homo sapiens
tgcacacagggagagaacatgagtctctcttaatttttatctggttgcta

SEQ ID NO: 4798 - DNA, 50 bp, Homo sapiens
ttcaatggaaaatgaggggtttctccccactgatattttacatagagtca

SEQ ID NO: 4799 - DNA, 50 bp, Homo sapiens
gaccacattgccaataaaaggtccctgaattccaaattctggaagcacgt

SEQ ID NO: 4800 - DNA, 50 bp, Homo sapiens
aggcccaaatcacagaataaaggactaagagtggatttgctgacattcca

SEQ ID NO: 4801 - DNA, 50 bp, Homo sapiens
gctgtcctcaaagtatataatgtttcatgtaccaagacccttttcacagt

SEQ ID NO: 4802 - DNA, 50 bp, Homo sapiens
aagggtatttggtctggttcatatggtcaaatattactgccttggtagca

SEQ ID NO: 4803 - DNA, 50 bp, Homo sapiens
ggggtgccaggaaatgctctctgacctatcaataaaggaaaagcagtgat

SEQ ID NO: 4804 - DNA, 50 bp, Homo sapiens
tgggaagggaaatttggggattatttatcctcctggggacagtttgggga

SEQ ID NO: 4805 - DNA, 50 bp, Homo sapiens
gccacaaaagttccctctcactttcagtaaaaataaataaaacagcagca

SEQ ID NO: 4806 - DNA, 50 bp, Homo sapiens; identical to SEQ ID NO: 923

SEQ ID NO: 4807 - DNA, 50 bp, Homo sapiens
gatacccaggaatttcacaggaacagttctttgctgcctttatcctccaa

SEQ ID NO: 4808 - DNA, 50 bp, Homo sapiens
cccaccctgccgcccgcattataaacacaggagaataatcaatagaataa

SEQ ID NO: 4809 - DNA, 50 bp, Homo sapiens
aaaccaggcccttaaacttcagctagacaaccaatatgctgtgcttgaaa

SEQ ID NO: 4810 - DNA, 50 bp, Homo sapiens
ccagatccacagcaggcacatatctctccaagggatgaccagttttatgc

SEQ ID NO: 4811 - DNA, 50 bp, Homo sapiens
ggacttgaagaccaaagactttgaaatttgcgagctgctcatgtgtgagt

SEQ ID NO: 4812 - DNA, 50 bp, Homo sapiens
gaaacggcataaagatgagaaatgagcctatttgttagtgttcgtgctta

SEQ ID NO: 4813 - DNA, 50 bp, Homo sapiens
cctgccctcgcctggaatcagtgttactgcatctgattaaatgtctccag

SEQ ID NO: 4814 - DNA, 50 bp, Homo sapiens; identical to SEQ ID NO: 606

SEQ ID NO: 4815 - DNA, 50 bp, Homo sapiens
cagagttgacggacactgctcccaaaaggtcattactcagaataaatgta

SEQ ID NO: 4816 - DNA, 50 bp, Homo sapiens
gaacctcaggcagcagttgtgaaggctttgggggaactagacattcttct

SEQ ID NO: 4817 - DNA, 50 bp, Homo sapiens
ggactgagaagcaagatatcaatgtagcagaattgcacttgtgcctcacg

SEQ ID NO: 4818 - DNA, 50 bp, Homo sapiens
caatggttgcaccttatgaccttgagggaaagccagttcatttaagagga

SEQ ID NO: 4819 - DNA, 50 bp, Homo sapiens
gggggaggggaggggttcgtacaggagcaataaaggagaaactgaggtac

SEQ ID NO: 4820 - DNA, 50 bp, Homo sapiens; identical to SEQ ID NO: 4819

SEQ ID NO: 4821 - DNA, 50 bp, Homo sapiens
acttcttggaactttaactcctgccagcccttctaagacccacgagcggg

SEQ ID NO: 4822 - DNA, 50 bp, Homo sapiens
tgttccatcagcatcccctttttgggcgaggagaaaatcgcaactttttc

SEQ ID NO: 4823 - DNA, 50 bp, Homo sapiens
cagactattccccacctgcttcccagcttcacaataaacggctgcgtctc

SEQ ID NO: 4824 - DNA, 50 bp, Homo sapiens; identical to SEQ ID NO: 4823

SEQ ID NO: 4825 - DNA, 50 bp, Homo sapiens
gtctgtgggcctcatgggcattgtggtgggcactgtcttcatcatccaag

SEQ ID NO: 4826 - DNA, 50 bp, Homo sapiens
ctccaaacagagcaacaacaagtacgcggccagcagctacctgagcctga

SEQ ID NO: 4827 - DNA, 50 bp, Homo sapiens
ccaaagtcctcactcagaccagtgcccctccagttcagttgtctatgtat

SEQ ID NO: 4828 - DNA, 50 bp, Homo sapiens
tgtcttccaccctcaagaaactcttgaacaagaccaacaagaaggcagcg

SEQ ID NO: 4829 - DNA, 50 bp, Homo sapiens
gcaggaccagaccctccaggaaaggcaagagactcatgaccaggggacag

SEQ ID NO: 4830 - DNA, 50 bp, Homo sapiens; identical to SEQ ID NO: 3444

SEQ ID NO: 4831 - DNA, 50 bp, Homo sapiens
agcttggtgtataccttgcaggcactagtcctttacagatgacaatgctg

SEQ ID NO: 4832 - DNA, 50 bp, Homo sapiens
aggaagagccacctgcaagatggacacgagccacaagctgcactgtgaac

SEQ ID NO: 4833 - DNA, 50 bp, Homo sapiens
gggtgcagcatggctctaacaagagaagagatcacagaaacgtgaggatc

SEQ ID NO: 4834 - DNA, 50 bp, Homo sapiens
tacattctccctttagcaacctgagtaagagactctctgccactgggctg

SEQ ID NO: 4835 - DNA, 50 bp, Homo sapiens
aactcttggcctcagaggaaggaaaagcaactcaacactcatggtcaagt

SEQ ID NO: 4836 - DNA, 50 bp, Homo sapiens
agggaacaagggagcaagggaacaagggacatctgaacatctaatgtgag

SEQ ID NO: 4837 - DNA, 50 bp, Homo sapiens
gtggcccctggacgggtacaataacacactgtactgatgtcacaactttg

SEQ ID NO: 4838 - DNA, 50 bp, Homo sapiens
cccctaccctgccccaattcaatcctgccaataaatcctgtcttatttgt

SEQ ID NO: 4839 - DNA, 50 bp, Homo sapiens
acacggaagtgaagattcctgaggatctaacttgcagttggacactatgt

SEQ ID NO: 4840 - DNA, 50 bp, Homo sapiens
cggtccttttgccatacacagttacagagatcagtcaaatccataccacc

SEQ ID NO: 4841 - DNA, 50 bp, Homo sapiens
atacctgtgaggactggttgtctctcttcggtgcccttgagtctctgaat

SEQ ID NO: 4842 - DNA, 50 bp, Homo sapiens
tcatctacttcaggaatcagaaaggacactctggacttcagccaacaggt

SEQ ID NO: 4843 - DNA, 50 bp, Homo sapiens
tgcttcttgaaatggatttaacaacagccaggagcttcctgtcagtaacc

SEQ ID NO: 4844 - DNA, 50 bp, Homo sapiens
ccctccccactgctgctgagtctgtctgatgttttggttgtgtgaataaa

SEQ ID NO: 4845 - DNA, 50 bp, Homo sapiens
aggaggaactggggaaggtggtcattcaggggaagaaccaggatgcaggg

SEQ ID NO: 4846 - DNA, 50 bp, Homo sapiens
tgggaaagtgtgagttaatattggacacattttatcctgatccacagtgg

SEQ ID NO: 4847 - DNA, 50 bp, Homo sapiens
ttaaaaggagcacattaaaattctcagaggacttggcaagggccgcacag

SEQ ID NO: 4848 - DNA, 50 bp, Homo sapiens
gcacacgccatctgtgtaacttcaggatctgttctgtttcaccatgtaac

SEQ ID NO: 4849 - DNA, 50 bp, Homo sapiens; identical to SEQ ID NO: 3493

SEQ ID NO: 4850 - DNA, 50 bp, Homo sapiens
aagagaaatatatgccctagagctgctccagcacccttggtttctgattt

SEQ ID NO: 4851 - DNA, 50 bp, Homo sapiens
acagacagactcgatgcccacacagcttcactctttgagcaacatggaat

SEQ ID NO: 4852 - DNA, 50 bp, Homo sapiens
gcacggtgtgttgccacgatttgaccctcaacttctagcagtatatcagt

SEQ ID NO: 4853 - DNA, 50 bp, Homo sapiens
agtgtagttactagtcttttgacatggatgattctgaggaggaagctgtt

SEQ ID NO: 4854 - DNA, 50 bp, Homo sapiens
tcactgccatacaggttttccaatacacaagtgctagaaaatacacacaa

SEQ ID NO: 4855 - DNA, 50 bp, Homo sapiens
ttgcttgccctccatgtcttcctaaagagcagaacttggagtttctcctt

SEQ ID NO: 4856 - DNA, 50 bp, Homo sapiens
agaatgagcctgaatgttggtggtttttgaaatcctgacttggaggtaaa

SEQ ID NO: 4857 - DNA, 50 bp, Homo sapiens
cctcggccctgacaaacggggatcttttacctcactttgcactgattaat

SEQ ID NO: 4858 - DNA, 50 bp, Homo sapiens
tggcttggccttctctttggtgatcccacccccagccatttgcattgctg

SEQ ID NO: 4859 - DNA, 50 bp, Homo sapiens
aatgtttctcttcctgtgagacttactaaagcaacttagtggcaaaaagt

SEQ ID NO: 4860 - DNA, 50 bp, Homo sapiens
agtacttgagtagtctcaataggagtgtatttgtagacagcagtttccct

SEQ ID NO: 4861 - DNA, 50 bp, Homo sapiens
accctagatgagctgtcctgctccagtaacattctttttctaaaatcatt

SEQ ID NO: 4862 - DNA, 50 bp, Homo sapiens; identical to SEQ ID NO: 971

SEQ ID NO: 4863 - DNA, 50 bp, Homo sapiens
atttgagttcctgtgtgtccaaaactgaggcaccatgttctttgaaaaca

SEQ ID NO: 4864 - DNA, 50 bp, Homo sapiens; identical to SEQ ID NO: 4863

SEQ ID NO: 4865 - DNA, 50 bp, Homo sapiens; identical to SEQ ID NO: 4863

SEQ ID NO: 4866 - DNA, 50 bp, Homo sapiens
gtccacagcggaccctgctgatgcctccaccatctatgcagttgtagttt

SEQ ID NO: 4867 - DNA, 50 bp, Homo sapiens
caggctcccatatgtaccccatcccccatactcacctctttccattttga

SEQ ID NO: 4868 - DNA, 50 bp, Homo sapiens
gttgtattggcaagagggaggggtgagagctgttggagaactgagaatga

SEQ ID NO: 4869 - DNA, 50 bp, Homo sapiens
gtaccatcctcaccgtagtcatcatcatcgccgcgcagcaccacgagaac

SEQ ID NO: 4870 - DNA, 50 bp, Homo sapiens; identical to SEQ ID NO: 817

SEQ ID NO: 4871 - DNA, 50 bp, Homo sapiens
atcgctgaatatgttgatcagtgatgagttgggcttaatgcaaagatcct

SEQ ID NO: 4872 - DNA, 50 bp, Homo sapiens
aggctatttacttccatgcttctccttttcttactctatagtggcaacat

SEQ ID NO: 4873 - DNA, 50 bp, Homo sapiens
gggacccccacccagtgagtcaacataggctcatgtcaagtttgaaaata

SEQ ID NO: 4874 - DNA, 50 bp, Homo sapiens
tggtgtgatatgaaccagtccattcacattggaaaaactgatggttttaa

SEQ ID NO: 4875 - DNA, 50 bp, Homo sapiens
tttttatcagcgcctcaatctctactcgaagaagaaagagaagaaacgtt

SEQ ID NO: 4876 - DNA, 50 bp, Homo sapiens
cgctgtcgccttaatccaagcctacgttttcacacttctagtaagcctct

SEQ ID NO: 4877 - DNA, 50 bp, Homo sapiens
ctgtcgggctctgaagcgagctggtttagttgtagaagatgctctgtttg

SEQ ID NO: 4878 - DNA, 50 bp, Homo sapiens
agaagcagaatgcagaaggagaatgaatcctttggatactttcaaggaca

SEQ ID NO: 4879 - DNA, 50 bp, Homo sapiens
tctggcacagtccagctcacaacaacatcaagagcagaatttggagactt

SEQ ID NO: 4880 - DNA, 50 bp, Homo sapiens
gggacttgactttctttctggactgtttgtattgaaacaaagtggtgtca

SEQ ID NO: 4881 - DNA, 50 bp, Homo sapiens; identical to SEQ ID NO: 607

SEQ ID NO: 4882 - DNA, 50 bp, Homo sapiens
agactggtgatttggagtagtttacaagattcctcattcagagtgccctc

SEQ ID NO: 4883 - DNA, 50 bp, Homo sapiens
ttgcctcctccaatctgtgttctcaactgtggttgccacctcattaactt

SEQ ID NO: 4884 - DNA, 50 bp, Homo sapiens
tggaacataccacatgtagaaaggttgaactggtttttcagctataatgc

SEQ ID NO: 4885 - DNA, 50 bp, Homo sapiens
tcacttagcctttctggtttcccttcctgtgcattgcccattttctcatg

SEQ ID NO: 4886 - DNA, 50 bp, Homo sapiens
agccaagaggtatatcgatgatggaaattagccacatgtacactacattt

SEQ ID NO: 4887 - DNA, 50 bp, Homo sapiens
cttcaccgccctacttccacctccgcccagcctgtaatgtttatataagc

SEQ ID NO: 4888 - DNA, 50 bp, Homo sapiens
ctttcagagccagtttgtccaaggccagcatcccgtctgggagatgcacc

SEQ ID NO: 4889 - DNA, 50 bp, Homo sapiens
gccgtatattactgtgcgagagggccggagtggttactcggtatggacgt

SEQ ID NO: 4890 - DNA, 50 bp, Homo sapiens
aggcaaaagcgcctcacgcattcttgttccttgtttgcttcttcggtttt

SEQ ID NO: 4891 - DNA, 50 bp, Homo sapiens
ttagaaagaaaagtcttttattagtactgtgtagggaaggctaaagaaat

SEQ ID NO: 4892 - DNA, 50 bp, Homo sapiens
actgtgcgaaacgtactgtattacgatttttggagtggccgaagtagtcc

SEQ ID NO: 4893 - DNA, 50 bp, Homo sapiens
cagaccctggtgatgctggaaacagttcctcggagtggagaggtttacac

SEQ ID NO: 4894 - DNA, 50 bp, Homo sapiens
gtccagcaacagtgcccagggctctgatgagtctctcatcgcttgtaaag

SEQ ID NO: 4895 - DNA, 50 bp, Homo sapiens
gtgtattactgtgcgagagccttccgccatcccggagtacgtccaatatg

SEQ ID NO: 4896 - DNA, 50 bp, Homo sapiens
cccgtccctcaagagtcgagtcaccatatcagtagacaagtccaagaacc

SEQ ID NO: 4897 - DNA, 50 bp, Homo sapiens
ggctccaggctcaggatgaggctgattattactgctgctcatatacaagc

SEQ ID NO: 4898 - DNA, 50 bp, Homo sapiens
ccctcactgtcaccttcccgagaataccctaagaccaataaatacttcag

SEQ ID NO: 4899 - DNA, 50 bp, Homo sapiens
tgaatgacttctatctgggaatcttgacggtgacctggaaggcagatggt

SEQ ID NO: 4900 - DNA, 50 bp, Homo sapiens; identical to SEQ ID NO: 2269

SEQ ID NO: 4901 - DNA, 50 bp, Homo sapiens
agaacagagatgattacacctacgaagtctgagttatggtgtgagttgga

SEQ ID NO: 4902 - DNA, 50 bp, Homo sapiens
ttcatcattgcttgcttgccttcctccctcctgtccgctctcactcactc

SEQ ID NO: 4903 - DNA, 50 bp, Homo sapiens; identical to SEQ ID NO: 2215

SEQ ID NO: 4904 - DNA, 50 bp, Homo sapiens
tgaagaacgaccaaaattatttgaagaactagggaaacagatccaacagt

SEQ ID NO: 4905 - DNA, 50 bp, Homo sapiens
gtctacatacttcccaggcacccagcatggaaataaagcacccaccactg

SEQ ID NO: 4906 - DNA, 50 bp, Homo sapiens
atacttcccaggcacccagcatggaaataaagcacccaccactgccctgg

SEQ ID NO: 4907 - DNA, 50 bp, Homo sapiens
cccaaggcatcaagcccttctccctgcactcaataaaccctcaataaata

SEQ ID NO: 4908 - DNA, 50 bp, Homo sapiens
aaggcagagatcttgacacctaaggagtctagtttagggctttggttgga

SEQ ID NO: 4909 - DNA, 50 bp, Homo sapiens
gttgacattagaagcaggattctctggtactccctcagaaaatagaatgc

SEQ ID NO: 4910 - DNA, 50 bp, Homo sapiens
ttggagcgtttttgtgtttgagatattagctcaggtcaattccaaagagt

SEQ ID NO: 4911 - DNA, 50 bp, Homo sapiens; identical to SEQ ID NO: 389

SEQ ID NO: 4912 - DNA, 50 bp, Homo sapiens; identical to SEQ ID NO: 392

SEQ ID NO: 4913 - DNA, 50 bp, Homo sapiens; identical to SEQ ID NO: 394

SEQ ID NO: 4914 - DNA, 50 bp, Homo sapiens
tctgttaccacctctaaaatattggggtggaataaagctgggttcttgca

SEQ ID NO: 4915 - DNA, 50 bp, Homo sapiens; identical to SEQ ID NO: 402

SEQ ID NO: 4916 - DNA, 50 bp, Homo sapiens; identical to SEQ ID NO: 403

SEQ ID NO: 4917 - DNA, 50 bp, Homo sapiens; identical to SEQ ID NO: 404

SEQ ID NO: 4918 - DNA, 50 bp, Homo sapiens
gggtaggcagcttgcacccagttctcctttatctcaacttattgtcctgg

SEQ ID NO: 4919 - DNA, 50 bp, Homo sapiens
acttggaacagaagaacttcggcaacgagaacactatctcaagcagaaga

SEQ ID NO: 4920 - DNA, 50 bp, Homo sapiens
gcggtgtccctgagtgagggcaaagttgtaataacacttgttctctcctt

SEQ ID NO: 4921 - DNA, 50 bp, Homo sapiens; identical to SEQ ID NO: 407

SEQ ID NO: 4922 - DNA, 50 bp, Homo sapiens; identical to SEQ ID NO: 408

SEQ ID NO: 4923 - DNA, 50 bp, Homo sapiens
ggctagtggtgttcagagaaataccaaaacgtgtttttatcattgctggt

SEQ ID NO: 4924 - DNA, 50 bp, Homo sapiens
agctgcctcaggaggttcttaacatataggaatgtaattatcagattcaa

SEQ ID NO: 4925 - DNA, 50 bp, Homo sapiens
aggaaaccaagccctcacaggaaagaaagcctgattcaagaaaacaaagt

SEQ ID NO: 4926 - DNA, 50 bp, Homo sapiens; identical to SEQ ID NO: 418

SEQ ID NO: 4927 - DNA, 50 bp, Homo sapiens; identical to SEQ ID NO: 419

SEQ ID NO: 4928 - DNA, 50 bp, Homo sapiens
gccattttccctccagaaacaaaaccaagataatttatcctgaacacggt

SEQ ID NO: 4929 - DNA, 50 bp, Homo sapiens; identical to SEQ ID NO: 421

SEQ ID NO: 4930 - DNA, 50 bp, Homo sapiens
aggaccatagggaagagccagccttgccttttcttatatgattttgttta

SEQ ID NO: 4931 - DNA, 50 bp, Homo sapiens; identical to SEQ ID NO: 424

SEQ ID NO: 4932 - DNA, 50 bp, Homo sapiens; identical to SEQ ID NO: 429

SEQ ID NO: 4933 - DNA, 50 bp, Homo sapiens
tcgttctacgttatctcatctccttgttttcagtgtgcttcaataatgca

SEQ ID NO: 4934 - DNA, 50 bp, Homo sapiens; identical to SEQ ID NO: 432

SEQ ID NO: 4935 - DNA, 50 bp, Homo sapiens
tgcacttactcattagtttttagtttgaactctcctgcgaggtctaatgt

SEQ ID NO: 4936 - DNA, 50 bp, Homo sapiens
tggttcttctgatgagcaagggaacaacactgagaatgaggaggaggagt

SEQ ID NO: 4937 - DNA, 50 bp, Homo sapiens
aagcaagagattgtaaaccgggtacagatccaagagatgagagaggaccc

SEQ ID NO: 4938 - DNA, 50 bp, Homo sapiens
cgtctactgcggaaaagtcaggggaaactgccaaacaaaggaaaatgccc

SEQ ID NO: 4939 - DNA, 50 bp, Homo sapiens
gtgtttgacttcactgctgcgaaatgactgtctcctggctagtaggatct

SEQ ID NO: 4940 - DNA, 50 bp, Homo sapiens; identical to SEQ ID NO: 1311

SEQ ID NO: 4941 - DNA, 50 bp, Homo sapiens; identical to SEQ ID NO: 1315

SEQ ID NO: 4942 - DNA, 50 bp, Homo sapiens; identical to SEQ ID NO: 1320

SEQ ID NO: 4943 - DNA, 50 bp, Homo sapiens; identical to SEQ ID NO: 1321

SEQ ID NO: 4944 - DNA, 50 bp, Homo sapiens
atgtctataaatggtgtcataactagagcacgggcgttatgtaagtttct

SEQ ID NO: 4945 - DNA, 50 bp, Homo sapiens; identical to SEQ ID NO: 1340

SEQ ID NO: 4946 - DNA, 50 bp, Homo sapiens
acataggcgaagaaaacatggcattgagtgtgctgagtccagacaaatgt

SEQ ID NO: 4947 - DNA, 50 bp, Homo sapiens; identical to SEQ ID NO: 1350

SEQ ID NO: 4948 - DNA, 50 bp, Homo sapiens; identical to SEQ ID NO: 1352

SEQ ID NO: 4949 - DNA, 50 bp, Homo sapiens; identical to SEQ ID NO: 1353

SEQ ID NO: 4950 - DNA, 50 bp, Homo sapiens; identical to SEQ ID NO: 1355

SEQ ID NO: 4951 - DNA, 50 bp, Homo sapiens; identical to SEQ ID NO: 1358

SEQ ID NO: 4952 - DNA, 50 bp, Homo sapiens; identical to SEQ ID NO: 4468

SEQ ID NO: 4953 - DNA, 50 bp, Homo sapiens
aatcacagcagtaactcccagtaggaaagattctcaaaggaatagttctt

SEQ ID NO: 4954 - DNA, 50 bp, Homo sapiens
cctggccttcaagaagtcgtagtggctattttctttggacaaaagtaaga

SEQ ID NO: 4955 - DNA, 50 bp, Homo sapiens
atagacagacggaggtcctgatatccatgggccaacggcttggattattc

SEQ ID NO: 4956 - DNA, 50 bp, Homo sapiens; identical to SEQ ID NO: 1510

SEQ ID NO: 4957 - DNA, 50 bp, Homo sapiens; identical to SEQ ID NO: 1517

SEQ ID NO: 4958 - DNA, 50 bp, Homo sapiens
gatatcagacagcatcgtctctgcgagcacaaagatctgtttgctgagca

SEQ ID NO: 4959 - DNA, 50 bp, Homo sapiens; identical to SEQ ID NO: 1537

SEQ ID NO: 4960 - DNA, 50 bp, Homo sapiens; identical to SEQ ID NO: 1548

SEQ ID NO: 4961 - DNA, 50 bp, Homo sapiens
aattaacggccatcacacccacgactgacggtgatcaaacaaattcacag

SEQ ID NO: 4962 - DNA, 50 bp, Homo sapiens; identical to SEQ ID NO: 1559

SEQ ID NO: 4963 - DNA, 50 bp, Homo sapiens; identical to SEQ ID NO: 3876

SEQ ID NO: 4964 - DNA, 50 bp, Homo sapiens
ctcatagcatagccagcattcagcacacacaaacctactgcccacatttg

SEQ ID NO: 4965 - DNA, 50 bp, Homo sapiens
cacatttgaaggccaaagggaaaacgggggaagcggaagggttggattgg

SEQ ID NO: 4966 - DNA, 50 bp, Homo sapiens
tacgaccactgagaaacgggccacccggcacacggatcttggaacacaaa

SEQ ID NO: 4967 - DNA, 50 bp, Homo sapiens; identical to SEQ ID NO: 3927

SEQ ID NO: 4968 - DNA, 50 bp, Homo sapiens; identical to SEQ ID NO: 3930

SEQ ID NO: 4969 - DNA, 50 bp, Homo sapiens; identical to SEQ ID NO: 3935

SEQ ID NO: 4970 - DNA, 50 bp, Homo sapiens; identical to SEQ ID NO: 3945

SEQ ID NO: 4971 - DNA, 50 bp, Homo sapiens; identical to SEQ ID NO: 3961

SEQ ID NO: 4972 - DNA, 50 bp, Homo sapiens; identical to SEQ ID NO: 3962

SEQ ID NO: 4973 - DNA, 50 bp, Homo sapiens
gcaggttatcgcaagatgtcttagagtagggttacggttctcagtgacac

SEQ ID NO: 4974 - DNA, 50 bp, Homo sapiens
aaatggctttaccaaacattgtcagtacctttacgtgttagaaggcattt

SEQ ID NO: 4975 - DNA, 50 bp, Homo sapiens; identical to SEQ ID NO: 3966

SEQ ID NO: 4976 - DNA, 50 bp, Homo sapiens
ccctacttgattaaagattgaggtggaattctagatgtggtcattcgtgt

SEQ ID NO: 4977 - DNA, 50 bp, Homo sapiens; identical to SEQ ID NO: 3981

SEQ ID NO: 4978 - DNA, 50 bp, Homo sapiens
agaaatggtacggggaatgtgaataacacgaaatggtatggggaaatgtg

SEQ ID NO: 4979 - DNA, 50 bp, Homo sapiens; identical to SEQ ID NO: 4002

SEQ ID NO: 4980 - DNA, 50 bp, Homo sapiens
tgttcttgtgctgctgttatctatactatttttgttcgtgccttctgact

SEQ ID NO: 4981 - DNA, 50 bp, Homo sapiens
gtctgggtgccaacttgagacaggtggtctaggaaattgcggtaagagcg

SEQ ID NO: 4982 - DNA, 50 bp, Homo sapiens; identical to SEQ ID NO: 4009

SEQ ID NO: 4983 - DNA, 50 bp, Homo sapiens; identical to SEQ ID NO: 4010

SEQ ID NO: 4984 - DNA, 50 bp, Homo sapiens
aggctgattcttggagatttaacaccccacaggcaatgggtttatagaca

SEQ ID NO: 4985 - DNA, 50 bp, Homo sapiens
tctcctttcagttcctttgtaggatttctgggcttgaaggatagtcttca

SEQ ID NO: 4986 - DNA, 50 bp, Homo sapiens; identical to SEQ ID NO: 4031

SEQ ID NO: 4987 - DNA, 50 bp, Homo sapiens
agaatgtcccacttgctgtctcttagaggctgagcttcatttctatgagc

SEQ ID NO: 4988 - DNA, 50 bp, Homo sapiens
caacctctggagagtgcctactgttagaagctgaagggatgtcaaagtca

SEQ ID NO: 4989 - DNA, 50 bp, Homo sapiens; identical to SEQ ID NO: 4041

SEQ ID NO: 4990 - DNA, 50 bp, Homo sapiens
gcctcagtacagagggggctctggaagtgtttgttgactgaataaacgga

SEQ ID NO: 4991 - DNA, 50 bp, Homo sapiens; identical to SEQ ID NO: 4054

SEQ ID NO: 4992 - DNA, 50 bp, Homo sapiens
tgcctaagagcaaagcatcctctgcgacaaaagaaaattactgtagtggc

SEQ ID NO: 4993 - DNA, 50 bp, Homo sapiens; identical to SEQ ID NO: 4057

SEQ ID NO: 4994 - DNA, 50 bp, Homo sapiens
gacatggagcccccggaaaagcgggtctggacaccaagtcgatgtgtgag

SEQ ID NO: 4995 - DNA, 50 bp, Homo sapiens
acagaatcagattttgcaggtgtccaacctatagtggctaagaattatgt

SEQ ID NO: 4996 - DNA, 50 bp, Homo sapiens; identical to SEQ ID NO: 4067

SEQ ID NO: 4997 - DNA, 50 bp, Homo sapiens; identical to SEQ ID NO: 4070

SEQ ID NO: 4998 - DNA, 50 bp, Homo sapiens; identical to SEQ ID NO: 4075

SEQ ID NO: 4999 - DNA, 50 bp, Homo sapiens; identical to SEQ ID NO: 4077

SEQ ID NO: 5000 - DNA, 50 bp, Homo sapiens
tggagatccttctacttggctgctgtattcatgcattatgttggtttgag

SEQ ID NO: 5001 - DNA, 50 bp, Homo sapiens
atttgtaccaaatctttgggattcattggcaaataatttcagtgtggtgt

SEQ ID NO: 5002 - DNA, 50 bp, Homo sapiens
ggttttagcagttctttagcccgtggtatttcagtgttgggtttcatagc

SEQ ID NO: 5003 - DNA, 50 bp, Homo sapiens
gggagccataagaacgactccaaaaagagccccaaaggaggacaaggggg

SEQ ID NO: 5004 - DNA, 50 bp, Homo sapiens
tcagggtcttggatactcaagagaaaggagacttgtggttaatgtttgga

SEQ ID NO: 5005 - DNA, 50 bp, Homo sapiens
tccttagcacacgaaaaagccccttcccctggattcatgtttcttatttc

SEQ ID NO: 5006 - DNA, 50 bp, Homo sapiens
aagcaagtagacaccttcataactatgaatgaagctgctgaagtagtgtt

SEQ ID NO: 5007 - DNA, 50 bp, Homo sapiens
tccattaaagatcgcaaatgttgaggtcctgtagcctgaaaactctctgc

SEQ ID NO: 5008 - DNA, 50 bp, Homo sapiens
ctgattcaaacaggttccaacgtaaaacgttcacacttccaccatttcct

SEQ ID NO: 5009 - DNA, 50 bp, Homo sapiens
tgatgttggtatgcttgccctgttacttatagacagtctttgtcataggc

SEQ ID NO: 5010 - DNA, 50 bp, Homo sapiens
ggtctttgtcccagtagagttcatagtctatttagtgtgcatgtttttcc

SEQ ID NO: 5011 - DNA, 50 bp, Homo sapiens
ttgtgtccaaaagtgttaacgaagactacttaacccaatgattggcgcga

SEQ ID NO: 5012 - DNA, 50 bp, Homo sapiens
atgcgtggatattgagaacttaggtgtctaatggggaggattattgctgt

SEQ ID NO: 5013 - DNA, 50 bp, Homo sapiens
aagcatttccatttcaacgagtttgtcagctttattaatgttgggcaaaa

SEQ ID NO: 5014 - DNA, 50 bp, Homo sapiens
aaacctaccactttaagaagacagcgatgggtaattctttattggcaggt

SEQ ID NO: 5015 - DNA, 50 bp, Homo sapiens
attcagcattagtttctcacatcttcccccaggtatccccaacagaatta

SEQ ID NO: 5016 - DNA, 50 bp, Homo sapiens
acacctctcttagggctccatcaaacagaacttttagactgagtaacgct

SEQ ID NO: 5017 - DNA, 50 bp, Homo sapiens; identical to SEQ ID NO: 4297

SEQ ID NO: 5018 - DNA, 50 bp, Homo sapiens
accatgaacagtgtgttgcttcagactattacaaagagaatggggcaggt

SEQ ID NO: 5019 - DNA, 50 bp, Homo sapiens
tttttgaaaagtatgtttggtagaaattagttgtatgccctcaggacggt

SEQ ID NO: 5020 - DNA, 50 bp, Homo sapiens
gaaattagtgtgaacatgtgggaagcccgatgcatgtgggtcagggatct

SEQ ID NO: 5021 - DNA, 50 bp, Homo sapiens
tccctgggtgataccattcaatgtcttaatgtacttgtggctcagacctg

SEQ ID NO: 5022 - DNA, 50 bp, Homo sapiens
cagacagcacagcctgagggtagcagcagccacccatgttcaggtaagtc

SEQ ID NO: 5023 - DNA, 50 bp, Homo sapiens
gccatgaggtggaggacgtggacctggagctgttcaacatctcggtgcag

SEQ ID NO: 5024 - DNA, 50 bp, Homo sapiens
tctgcacccaaacaaataccttttgagatttcttataggcattcctctcg

SEQ ID NO: 5025 - DNA, 50 bp, Homo sapiens
gaagctctgccgcagcgccaggcacttcctacaccactactacgtccacg

SEQ ID NO: 5026 - DNA, 50 bp, Homo sapiens
cagctcggaccaccgccacctccctttttatttacagatcacccagtaag

SEQ ID NO: 5027 - DNA, 50 bp, Homo sapiens
ggtcccctcctggagactccctcacaaaatctttccccaagctgttcccc

SEQ ID NO: 5028 - DNA, 50 bp, Homo sapiens
tgaatgggcgtttatcttaatgaccagttattgaccaaagtgtactcaga

SEQ ID NO: 5029 - DNA, 50 bp, Homo sapiens
agcctattcctattctctagcctattccttaccacctgtaatcttgacca

SEQ ID NO: 5030 - DNA, 50 bp, Homo sapiens
gcaatgggcggccaactatgaaccctacgtggtggtgccacgagactgtc

SEQ ID NO: 5031 - DNA, 50 bp, Homo sapiens
gcctggagcttggctttgtatccaagtgtatggttgctttgtctaagagg

SEQ ID NO: 5032 - DNA, 50 bp, Homo sapiens; identical to SEQ ID NO: 1495

SEQ ID NO: 5033 - DNA, 50 bp, Homo sapiens
agcctacaagccacctcgccactgtgaacttgtcgtcactcttggatgtc

SEQ ID NO: 5034 - DNA, 50 bp, Homo sapiens
cctgctcacagaccaggaactctacaagctggaccctgaccggcagtacc

SEQ ID NO: 5035 - DNA, 50 bp, Homo sapiens
agcagttccacagtgtttcacactacaggatttaaatattttgctccaga

SEQ ID NO: 5036 - DNA, 50 bp, Homo sapiens
cctttatccacctggattttagggacaaacactgaaaacgaataagtcca

SEQ ID NO: 5037 - DNA, 50 bp, Homo sapiens; identical to SEQ ID NO: 5036

SEQ ID NO: 5038 - DNA, 50 bp, Homo sapiens
cagagaacgaaagtcaagtgcagcgagttgggtggaagctgatagagcaa

SEQ ID NO: 5039 - DNA, 50 bp, Homo sapiens
ccacaaaccattcagatcaggcacttgctgaccctggttcttaaggacac

SEQ ID NO: 5040 - DNA, 50 bp, Homo sapiens
aagaaactatgtagcatagtgtcttaacacctcagtaaagtaagctggcc

SEQ ID NO: 5041 - DNA, 50 bp, Homo sapiens
agcaggagacagcttcctgatctagatgtacaattagagtttaggttgga

SEQ ID NO: 5042 - DNA, 50 bp, Homo sapiens
tggaactagtcacaattgaagttcttcatccagtaggtgttaaacagtgt

SEQ ID NO: 5043 - DNA, 50 bp, Homo sapiens
cccacacaagtgcgccacataaatctgcgagactccacgacaacacaggg

SEQ ID NO: 5044 - DNA, 50 bp, Homo sapiens
gcaaacaagttctaaagttgtggagaaaaagtgatgtggtcaagagttga

SEQ ID NO: 5045 - DNA, 50 bp, Homo sapiens
gcaagaaagagaaacgtaaaaacagatagagattctgcctgtgctttggt

SEQ ID NO: 5046 - DNA, 50 bp, Homo sapiens
gagagttgctggtgtaaaatacgtttgaaatagttgatctacaaaggcca

SEQ ID NO: 5047 - DNA, 50 bp, Homo sapiens
ggttaacgcttctgtgaggaccttctggctcttgagataccctaaatatt

SEQ ID NO: 5048 - DNA, 50 bp, Homo sapiens
actttcattggtaaataagcctgtcttcctatctggatttttggtgtgca

SEQ ID NO: 5049 - DNA, 50 bp, Homo sapiens
cagttatttaaaggctgacaactgccttccagacccgcgctgtattaata

SEQ ID NO: 5050 - DNA, 50 bp, Homo sapiens
tggtgggtacagaaacattgtcacagggatcctggaacagaggaagagtt

SEQ ID NO: 5051 - DNA, 50 bp, Homo sapiens
ttctgacctaataattacgggaaatggaaagtctgggccagcatcaataa

SEQ ID NO: 5052 - DNA, 50 bp, Homo sapiens
tgggtcggcaaagctattataactttgaatgctaacggcatgtttgacct

SEQ ID NO: 5053 - DNA, 50 bp, Homo sapiens
gctgtgtcctttctggcacaatcggggattccattctttagacactggaa

SEQ ID NO: 5054 - DNA, 50 bp, Homo sapiens
ttgacaaagatgacatcgccccaagagccaaaaataaatgggaattgaaa

SEQ ID NO: 5055 - DNA, 50 bp, Homo sapiens
gtaaagatcagaataccaaggccagctaaggcaacgactccctccccaaa

SEQ ID NO: 5056 - DNA, 50 bp, Homo sapiens; identical to SEQ ID NO: 1668

SEQ ID NO: 5057 - DNA, 50 bp, Homo sapiens
atgctggtgtcatgtgacatttgttgagtctcgggcatgttcacggtggg

SEQ ID NO: 5058 - DNA, 50 bp, Homo sapiens
ggaaattgtgccaaaaccatggaaaatattactgtgtgtggggtgtctgt

SEQ ID NO: 5059 - DNA, 50 bp, Homo sapiens
tttgtgtgtgaaatataacattgattgaattgcagttacatttggttagt

SEQ ID NO: 5060 - DNA, 50 bp, Homo sapiens; identical to SEQ ID NO: 1868

SEQ ID NO: 5061 - DNA, 50 bp, Homo sapiens
taaggttaggcaataacttaggggtatattctcttcctgcatcccagtgc

SEQ ID NO: 5062 - DNA, 50 bp, Homo sapiens
taaggtgtttgctgggggatgttgtgtgtattaggggagtgtttcccttg

SEQ ID NO: 5063 - DNA, 50 bp, Homo sapiens; identical to SEQ ID NO: 3550

SEQ ID NO: 5064 - DNA, 50 bp, Homo sapiens; identical to SEQ ID NO: 3567

SEQ ID NO: 5065 - DNA, 50 bp, Homo sapiens
actggtgttggtgcttttgtctgtcataccatagtattttcaaaacttca

SEQ ID NO: 5066 - DNA, 50 bp, Homo sapiens
ccttgagaaacacccatctccacttcctagacaaaccaatgaacattagt

SEQ ID NO: 5067 - DNA, 50 bp, Homo sapiens; identical to SEQ ID NO: 3688

SEQ ID NO: 5068 - DNA, 50 bp, Homo sapiens
ctaagtcattgcaggaacggggctgtgttctctgctgggacaaaacagga

SEQ ID NO: 5069 - DNA, 50 bp, Homo sapiens
gccgttctttatagaacaattcctttctcttctcttgaatgtggcagtca

SEQ ID NO: 5070 - DNA, 50 bp, Homo sapiens
agcctacctccctaccccaagctgtctgttgagagcagtgctgaccccag

SEQ ID NO: 5071 - DNA, 50 bp, Homo sapiens
tttcataaacccactccttcctcttcacccacttgcaatccgcatgcttc

SEQ ID NO: 5072 - DNA, 50 bp, Homo sapiens
caagttggtttagttatgtaacaacctgacatgatggaggaaaacaacct

SEQ ID NO: 5073 - DNA, 50 bp, Homo sapiens
gactcgttacgccgtagtttgtcctatcttgtttatcaaatgaatttcgt

SEQ ID NO: 5074 - DNA, 50 bp, Homo sapiens
agccgcccagctacttaatccctcagtaacatctatctaaatctcccatg

SEQ ID NO: 5075 - DNA, 50 bp, Homo sapiens
tggcctgtgcttttaccacaccgtcaaacccttgatcatttctgtaaaca

SEQ ID NO: 5076 - DNA, 50 bp, Homo sapiens
acattctcatagtccaggggctcaacaactttggccttttccagcaccac

SEQ ID NO: 5077 - DNA, 50 bp, Homo sapiens
tcagcagttgtgccttttctcacagatccagccgtccttctcgctgtcac

SEQ ID NO: 5078 - DNA, 50 bp, Homo sapiens
tgcaagcaataaaatcttgctttaatcagtaaccactgtctgacaggaca

SEQ ID NO: 5079 - DNA, 50 bp, Homo sapiens
ggtcgtagagaagacagcaagggaggggataaaacccaggaaggacttaa

SEQ ID NO: 5080 - DNA, 50 bp, Homo sapiens
ggctcacgatgacaaccgcctacggaaaaactctaattcctaaacatcta

SEQ ID NO: 5081 - DNA, 50 bp, Homo sapiens
gacaagccaggtcagcccagattgccaaagcagcacttgcctacaccagc

SEQ ID NO: 5082 - DNA, 50 bp, Homo sapiens
ggttcccttgaagcagtgccaacctaaatctacctcaggtaagtagttag

SEQ ID NO: 5083 - DNA, 50 bp, Homo sapiens
gctgacagtatggaggctaaaggtgtggaggaaccaggaggagatgagta

SEQ ID NO: 5084 - DNA, 50 bp, Homo sapiens
caagtgtgccgggcaagtttgggaaggtgaagcaatctgtgacttaaata

SEQ ID NO: 5085 - DNA, 51 bp, Homo sapiens
gagctactcaaggggaaaaaagggcatatagtatgctctggtagtaaaagt

SEQ ID NO: 5086 - DNA, 50 bp, Homo sapiens; identical to SEQ ID NO: 4220

SEQ ID NO: 5087 - DNA, 50 bp, Homo sapiens
tggtgataatagagattgtttctgccctgggggtagttcaaggataacac

SEQ ID NO: 5088 - DNA, 50 bp, Homo sapiens
cttcaggtttggcccagcccctccttgaagactccttccatccagtcaag

SEQ ID NO: 5089 - DNA, 50 bp, Homo sapiens
cccaagtgaagtcaaagttactgtgtggttgatagggaacatggctggat

SEQ ID NO: 5090 - DNA, 50 bp, Homo sapiens
acccgcagaccagatggttgaaaggaaaaattaaagccttcttggggatt

SEQ ID NO: 5091 - DNA, 50 bp, Homo sapiens
ggagttagatcaaccttatggggaagggaaaggcagggcttgtgacaatt

SEQ ID NO: 5092 - DNA, 50 bp, Homo sapiens
gatggctgcttggttgctaaacccagacagggtccttccagtgcatctgc

SEQ ID NO: 5093 - DNA, 50 bp, Homo sapiens
catttgtgggtggagggttttgaatgtcctctttccatgtcaggcaaagg

SEQ ID NO: 5094 - DNA, 50 bp, Homo sapiens
ttctatgaaggtttccctggacaagaaactgccagagagcccttagctca

SEQ ID NO: 5095 - DNA, 50 bp, Homo sapiens
tgctgaatgtacctgagtgtatgtatttaaaaggactcacatgggcatca

SEQ ID NO: 5096 - DNA, 50 bp, Homo sapiens
tctcaaccctaatattcattgttccatgagcattgtcaggttttggatgg

SEQ ID NO: 5097 - DNA, 50 bp, Homo sapiens
acaagtggaagaggaagacagaagaatgggtcagggagatgcaaggatgg

SEQ ID NO: 5098 - DNA, 50 bp, Homo sapiens
tccttagggaaaagaagattttcaaacccttcgttagtttcggtagggcc

SEQ ID NO: 5099 - DNA, 50 bp, Homo sapiens
acgcaatttgttcacatacatacacatgcaaatcccaaaagaaggtttta

SEQ ID NO: 5100 - DNA, 50 bp, Homo sapiens
cccagccctctatgtacccgtgtcccagccagcaataaatgccatcttgg

SEQ ID NO: 5101 - DNA, 50 bp, Homo sapiens
agcctggaattctaagcagcagtttcacaatctgtaattgcacgtttctg

SEQ ID NO: 5102 - DNA, 50 bp, Homo sapiens
tggttactcatgtcctcaaagacgactcatgatgctggatatgaagaact

SEQ ID NO: 5103 - DNA, 50 bp, Homo sapiens
aggcaaaagtcatttcttccctatattttgtcatgcttatctcctgtctc

SEQ ID NO: 5104 - DNA, 50 bp, Homo sapiens
gtatgaaggcaagaaaatttcaggggaaaacaagtggttattttctggcc

SEQ ID NO: 5105 - DNA, 50 bp, Homo sapiens
gataccctcttcctaagactcatcgcgtctcttccagcctcctcgcccca

SEQ ID NO: 5106 - DNA, 50 bp, Homo sapiens
tctgtatgctgtggtctcatcaggaacctttctctgcactgcatttttcc

SEQ ID NO: 5107 - DNA, 50 bp, Homo sapiens
agagctggttccagaaggttcggatgagtcctgaatgtttatgtagggca

SEQ ID NO: 5108 - DNA, 50 bp, Homo sapiens
tccttagtctccttcaatttccacacactgaacatgacattttacccttt

SEQ ID NO: 5109 - DNA, 50 bp, Homo sapiens
ttttctgttttctgttttaagaaaatctggaaccgcaaggccgtcccttt

SEQ ID NO: 5110 - DNA, 50 bp, Homo sapiens
ccaaagcctttgttgtttggtggcgaggcccctttttgaatggggttttt

SEQ ID NO: 5111 - DNA, 50 bp, Homo sapiens
tgccgcccccaggattcttttaagaataaaaagaaatgagtgtggacatg

SEQ ID NO: 5112 - DNA, 50 bp, Homo sapiens
cctacgatatccttttcaaataggggtgggtccagcccccttgtgccctg

SEQ ID NO: 5113 - DNA, 50 bp, Homo sapiens
ctgggagaaaggtactttgggttagtggtagggatagggatgaacgggaa

SEQ ID NO: 5114 - DNA, 50 bp, Homo sapiens
agcataatcctaatgaggaactttgtctgaagtctgaggctgagttactt

SEQ ID NO: 5115 - DNA, 50 bp, Homo sapiens
ttttggaacccttagccctgtgcaaatcaaaggatgtgaggggaaaaagg

SEQ ID NO: 5116 - DNA, 50 bp, Homo sapiens
atttcccctacggatgggaccaagaaactgatgagaacggccaagtgttt

SEQ ID NO: 5117 - DNA, 50 bp, Homo sapiens
aacacccgaaaccgtcttctgtggcatttgtcagttgaaaaagaacacct

SEQ ID NO: 5118 - DNA, 50 bp, Homo sapiens
ccagtggctgggatggtgacagtgacatccacagtaaacagatgaaatgt

SEQ ID NO: 5119 - DNA, 50 bp, Homo sapiens
ggatttcagaaacagttgcagatattattgattagctagttggcagtggg

SEQ ID NO: 5120 - DNA, 50 bp, Homo sapiens
cttgttcccaggccagccccacacagtaggcagtcattaaagtttggtga

SEQ ID NO: 5121 - DNA, 50 bp, Homo sapiens
ttttccttcaactcttgcgactttcttggtctgcctgtgtggttttaata

SEQ ID NO: 5122 - DNA, 50 bp, Homo sapiens
ttctgttaatagcaaacattgcctttgagtgctactactaaacctgaggc

SEQ ID NO: 5123 - DNA, 50 bp, Homo sapiens
tctagggatctgcccggctcaaaatcccaggccgttaggctaagttgttc

SEQ ID NO: 5124 - DNA, 50 bp, Homo sapiens
cggacaagggctggcaggtaaatgccttcagtttgttgttaaatagaggc

SEQ ID NO: 5125 - DNA, 50 bp, Homo sapiens
agccttagcccctttaaagcacttaaagttactacttccaaatgtgattt

SEQ ID NO: 5126 - DNA, 50 bp, Homo sapiens
accttgtcattaacagctcactttgattgaacatctactctgtggcggtt

SEQ ID NO: 5127 - DNA, 50 bp, Homo sapiens
tggaacggctatttgccggtttaaaaaccaaaaaccccggtttttccaaa

SEQ ID NO: 5128 - DNA, 50 bp, Homo sapiens
gtaaggcagacgagagaggcggaggtctcacagtgaaccacaggatctgg

SEQ ID NO: 5129 - DNA, 50 bp, Homo sapiens
ttgcctgccatgcccttataagtgccctttaatgtcatagcatgtaaagg

SEQ ID NO: 5130 - DNA, 50 bp, Homo sapiens
gggtttgtgtccccatttagaatctgatgaaacggtgggctttccttctt

SEQ ID NO: 5131 - DNA, 50 bp, Homo sapiens
cagagcctccagaattatgtgaacttgtctcaaaacattctctaaatggc

SEQ ID NO: 5132 - DNA, 50 bp, Homo sapiens
gaaaggacccgagggtttgtatttaaaaagcctcccctgggcctcaaaaa

SEQ ID NO: 5133 - DNA, 50 bp, Homo sapiens; identical to SEQ ID NO: 4265

SEQ ID NO: 5134 - DNA, 50 bp, Homo sapiens
tgtctagaacagactgagagtgacacgcatatttgattgtgaggacagtt

SEQ ID NO: 5135 - DNA, 50 bp, Homo sapiens
gtttggcccccaaagtgtttaggagagctttctccctagatcgccctgtg

SEQ ID NO: 5136 - DNA, 50 bp, Homo sapiens
ccaggagggccagaatttgaaaattccttggggttgttctttttccaaaa

SEQ ID NO: 5137 - DNA, 50 bp, Homo sapiens
cagtttgagcaaaagcctttgaaatccaagacttttccccttggggtgct

SEQ ID NO: 5138 - DNA, 50 bp, Homo sapiens
ccagttggtttttggactccaaagcccaggacccttccaaatcctgcttg

SEQ ID NO: 5139 - DNA, 50 bp, Homo sapiens
aggcctttttcaaagaaaaacccctttggggaaaaagggaaagggcaaaa

SEQ ID NO: 5140 - DNA, 50 bp, Homo sapiens
ttttgcttgctgtcgggagaataaagcagggaacctttatgtagtgaaaa

SEQ ID NO: 5141 - DNA, 50 bp, Homo sapiens
gggtttggcccgattatattaggttgggtgggggaaaaattttatggggg

SEQ ID NO: 5142 - DNA, 50 bp, Homo sapiens
gtgaactggatcttgaggccgtgctggaaaccggaaggtacactgcttgg

SEQ ID NO: 5143 - DNA, 50 bp, Homo sapiens
caaaacttgagataaggttaaaactgtgcccagaggaaaactggtagtct

SEQ ID NO: 5144 - DNA, 50 bp, Homo sapiens
tgcagccagattgttccaaggttgccaattacctagtgggtaaatttccc

SEQ ID NO: 5145 - DNA, 50 bp, Homo sapiens
agtgcttatcatgaaatgtgcttcactggttcagctctgttgtttcctta

SEQ ID NO: 5146 - DNA, 50 bp, Homo sapiens
gttatttgggagacaaatggacgggcaggaagattgatgctccgctgttc

SEQ ID NO: 5147 - DNA, 50 bp, Homo sapiens
agctgaagggcttcaactttgcttggatttttaaatattttccttgcata

SEQ ID NO: 5148 - DNA, 50 bp, Homo sapiens
tgcaggctcattgtgctccttcttctgggtttcaattggatttcagtcct

SEQ ID NO: 5149 - DNA, 50 bp, Homo sapiens
atctctaatgaagcctaggatcagatttgtggcataccaacagcacatgt

SEQ ID NO: 5150 - DNA, 50 bp, Homo sapiens
ccacaagggttagtttgggccttaaaactgccaaggagtttccaaggatt

SEQ ID NO: 5151 - DNA, 50 bp, Homo sapiens
cgctttattcccacgaaacctaggacagtggccatcaaaccgagcgcttt

SEQ ID NO: 5152 - DNA, 50 bp, Homo sapiens
cctgttgtggctggctgcataataatttccaggaggctttcggaaatgtt

SEQ ID NO: 5153 - DNA, 50 bp, Homo sapiens
cggtccagtcggctgcttccattccctgaagaagaggccctaaagttaaa

SEQ ID NO: 5154 - DNA, 50 bp, Homo sapiens
ttagcctcaaaggggtggggaaaagcccatacctcctgggccagtcctag

SEQ ID NO: 5155 - DNA, 50 bp, Homo sapiens
ccttagaattaagttgaattttcctgccttgctaagcaagacttcctgca

SEQ ID NO: 5156 - DNA, 50 bp, Homo sapiens
cagccacggcccctcgcgtcttcgcggcacgttaattaaatgcggaaaac

SEQ ID NO: 5157 - DNA, 50 bp, Homo sapiens
ttttacccaaattttaaaggccggataaaagggtttttgtttggaaggga

SEQ ID NO: 5158 - DNA, 50 bp, Homo sapiens
ggaggttagggcctgaagctcaaagctccccctttttaatagtttttccc

SEQ ID NO: 5159 - DNA, 50 bp, Homo sapiens
cccctttgggccccccgggttttccctttttggtttcgggttgttttttg

SEQ ID NO: 5160 - DNA, 50 bp, Homo sapiens
acgtgggcctttggaccccttataagatggtcataagaccccaaaactga

SEQ ID NO: 5161 - DNA, 50 bp, Homo sapiens
atggctataaggccaaaaaagtttggcggcatgggggattttttgctctt

SEQ ID NO: 5162 - DNA, 50 bp, Homo sapiens
agagacggccacctgagaccaattagaatatccacaccagtggaagagag

SEQ ID NO: 5163 - DNA, 50 bp, Homo sapiens
gcctccccaacccctggcctcaatttccctttctataaaatggaagatgt

SEQ ID NO: 5164 - DNA, 50 bp, Homo sapiens
acacccagccaaagaaaagcatacctgaatccaagagagtatttacactg

SEQ ID NO: 5165 - DNA, 50 bp, Homo sapiens
ctcagagaagaacagtgtagaaacccgcgctgtgtgaagcgaggttgggc

SEQ ID NO: 5166 - DNA, 50 bp, Homo sapiens
actttccattgttgagctggggagttggattttgtccatttgtttttatg

SEQ ID NO: 5167 - DNA, 50 bp, Homo sapiens
tcccagtgatgattcgctccctttgttaattactcagtgtttcttgtttt

SEQ ID NO: 5168 - DNA, 50 bp, Homo sapiens
tgcgtgctgctaatacttaggtacccataataggtctttacactcagttt

SEQ ID NO: 5169 - DNA, 50 bp, Homo sapiens
cctgaccttgaggcatttttgattgtgcagttacctagggtatgcttgtg

SEQ ID NO: 5170 - DNA, 50 bp, Homo sapiens
gaggactgggaccgtgattccactaaccggaaaccgtcgcctttcgggcc

SEQ ID NO: 5171 - DNA, 50 bp, Homo sapiens
ggggaagtcaaggagacacacacgctctttcaacagaatcagctcttaat

SEQ ID NO: 5172 - DNA, 50 bp, Homo sapiens
aactagatcctgccttagaaaaccttttgccatgaatgacaaattcatgt

SEQ ID NO: 5173 - DNA, 50 bp, Homo sapiens
tgtcagcatctggaatagtgtaagtatgcagtggaggaaatctcatcctt

SEQ ID NO: 5174 - DNA, 50 bp, Homo sapiens
ttaacaggacctctgggccaccaaggagaaagggctggggaagccaagag

SEQ ID NO: 5175 - DNA, 50 bp, Homo sapiens
gttctgtgatagtttgtttcccctcatctccctcacctctgcctgggttg

SEQ ID NO: 5176 - DNA, 50 bp, Homo sapiens
ggcccctccttttgctggagagttttttataaactggagcccgatttcat

SEQ ID NO: 5177 - DNA, 50 bp, Homo sapiens
gggctttttcttcccctaatcagggtgacctgggccttttgggcaggatc

SEQ ID NO: 5178 - DNA, 50 bp, Homo sapiens
aaggaggggagtgaatgatattgctgtcatttctcagcaaatcatagtga

SEQ ID NO: 5179 - DNA, 50 bp, Homo sapiens
taaaattctctgtgggaaaaagcctgccaataaaatgggggtttttgggc

SEQ ID NO: 5180 - DNA, 50 bp, Homo sapiens
acagactaagctggtttggtggattcatctttcacttatgaagaaagcag

SEQ ID NO: 5181 - DNA, 50 bp, Homo sapiens
cccaaagcctggggggtttggcccaaaccttccccctggtttttataaaa

SEQ ID NO: 5182 - DNA, 50 bp, Homo sapiens
actgctttcaagaaagtgggaccagtggcattgtagccaccataatcact

SEQ ID NO: 5183 - DNA, 50 bp, Homo sapiens
gcccttggcaaatgatttgagaccccttttgaaaaccatgtaggatgaat

SEQ ID NO: 5184 - DNA, 50 bp, Homo sapiens
cacacagcagtggcttggggatgaggaaggaagggagaatctcaacggag

SEQ ID NO: 5185 - DNA, 50 bp, Homo sapiens
tttttctgtgagttaggggcatggaggcggcagtgttgggagctggagcc

SEQ ID NO: 5186 - DNA, 51 bp, Homo sapiens
agttggctctagtttaaagatataaatacgtacctcacttaaaccccatgt

SEQ ID NO: 5187 - DNA, 50 bp, Homo sapiens
cttcaggcccaagttcaacgggttaaagaggtccgctcccaaattattct

SEQ ID NO: 5188 - DNA, 50 bp, Homo sapiens
gtcccagtagccccatttcagggcttgctagttacatgggtttgtgttta

SEQ ID NO: 5189 - DNA, 50 bp, Homo sapiens
ggatgtgtgatgtttatatgggagaacaaaaagctgatgtatagccctgt

SEQ ID NO: 5190 - DNA, 50 bp, Homo sapiens
caatttccacctctaagggggtcgggaaaggcacgctgagggtgaatatg

SEQ ID NO: 5191 - DNA, 50 bp, Homo sapiens
gctttcaaatgaatttcagggctttctttgaagcagtcttgtaaagttgt

SEQ ID NO: 5192 - DNA, 50 bp, Homo sapiens
tcctttctggataccaggaatcacttaaaaatctgtgtataatgccccca

SEQ ID NO: 5193 - DNA, 50 bp, Homo sapiens
aaacagggaacgacaggaaaaagatgaccgtgatacactctgctaaaagc

SEQ ID NO: 5194 - DNA, 50 bp, Homo sapiens
cccccccggcttcccccttttttccccgcccgtttttttgggggaatggg

SEQ ID NO: 5195 - DNA, 50 bp, Homo sapiens
ggccatgccgggccagccccacctgaagctcagtgaaagctgattaaaaa

SEQ ID NO: 5196 - DNA, 50 bp, Homo sapiens
cgcaggactctaaagatccaagctcacaaaacactccaaatccacctcga

SEQ ID NO: 5197 - DNA, 50 bp, Homo sapiens
aactttacttctgttcttggcaggacatggagagagggagggattccaaa

SEQ ID NO: 5198 - DNA, 50 bp, Homo sapiens
gggtgataattgagggtgccgctgggaaggtccgagaatgggttttcatg

SEQ ID NO: 5199 - DNA, 50 bp, Homo sapiens
gttcattgctgttcagagtgttgctgctgtggtgctataaatgctcccag

SEQ ID NO: 5200 - DNA, 50 bp, Homo sapiens
tattccaccagtgagctacactcccggcccctttagtgttgtttgtaaac

SEQ ID NO: 5201 - DNA, 50 bp, Homo sapiens
ccgtgttgtggcaaaatggtccctggagtttttgaccctgtgtttaaaga

SEQ ID NO: 5202 - DNA, 50 bp, Homo sapiens
ttttttggggccgaaaacccccaatgagggggattaaagctgttttcccc

SEQ ID NO: 5203 - DNA, 50 bp, Homo sapiens
ggggttgtccttttcccaccctgatggggaatttatggatgggtttcctt

SEQ ID NO: 5204 - DNA, 50 bp, Homo sapiens
aaatgagtgaccaaaacacttctgtaccacttctgtgagctgaggtccag

SEQ ID NO: 5205 - DNA, 50 bp, Homo sapiens
aggaacctaaagaaactgccaagtgtagataagcattgagtatgttaccc

SEQ ID NO: 5206 - DNA, 50 bp, Homo sapiens
ggttgtccagttttcggtttttaacgccccccataggggatttggccccc

SEQ ID NO: 5207 - DNA, 50 bp, Homo sapiens
gttttggaatgaggaatgatttttctaagcctgacatcagatgtctgaca

SEQ ID NO: 5208 - DNA, 50 bp, Homo sapiens
gaaattctccccttttcccctctccttcccttctgctgacctgttctcag

SEQ ID NO: 5209 - DNA, 50 bp, Homo sapiens
cacagagggagtgtgcagggccagatttcatcctggggccacgctgaaat

SEQ ID NO: 5210 - DNA, 50 bp, Homo sapiens
tgataggacatagtagtacgggtggtcagacatgaaaatggtggggagcc

SEQ ID NO: 5211 - DNA, 50 bp, Homo sapiens
caatacctacccccagtggcagccgcctgctcctcatgacccaagtaagt

SEQ ID NO: 5212 - DNA, 50 bp, Homo sapiens
tgttttaacaactcttctcaacattttgtccaggttattccctgtaacca

SEQ ID NO: 5213 - DNA, 50 bp, Homo sapiens
taagtgtcaggtttgtggggaaggttattcttgccttgtgtattttgtcc

SEQ ID NO: 5214 - DNA, 50 bp, Homo sapiens
caaacccctatcccccattctcctcctatccctcaaccccgacatcatta

SEQ ID NO: 5215 - DNA, 50 bp, Homo sapiens
cctgcaacagctaaggccaagccaaacttaccgtggactcaaacactttg

SEQ ID NO: 5216 - DNA, 50 bp, Homo sapiens; identical to SEQ ID NO: 372

SEQ ID NO: 5217 - DNA, 50 bp, Homo sapiens
tcccaccccttttctactgaatttgtggggatcctataataaaagtgaat

SEQ ID NO: 5218 - DNA, 50 bp, Homo sapiens
actaccagagccctaggacttctgagcacatttagaaaataccagaggca

SEQ ID NO: 5219 - DNA, 50 bp, Homo sapiens
catgtcagagttcttaacagaaagcaaaggtttccaacagcacttgcatt

SEQ ID NO: 5220 - DNA, 50 bp, Homo sapiens
atgaaatctcatggggccaaactgcacatcagctactgctaccttcttgc

SEQ ID NO: 5221 - DNA, 50 bp, Homo sapiens
ccctgtggcaacttgtgggtacggtttaactggaccacgctgagcttctg

SEQ ID NO: 5222 - DNA, 50 bp, Homo sapiens
agaaatagtgtttctcggaagctcagtttggagctgactgcacacgttgc

SEQ ID NO: 5223 - DNA, 50 bp, Homo sapiens
gttgctggctgccctcccctgcactctccctgaaataaagaacagcttgg

SEQ ID NO: 5224 - DNA, 50 bp, Homo sapiens; identical to SEQ ID NO: 5223

SEQ ID NO: 5225 - DNA, 50 bp, Homo sapiens
acgtgtcagacacaatcctgagccttctacaagtgttccctcttactcct

SEQ ID NO: 5226 - DNA, 50 bp, Homo sapiens
aagccctgtttacccaggtttttcttaaggcgagaaggtttagggtggtg

SEQ ID NO: 5227 - DNA, 50 bp, Homo sapiens
gagaaagctcccagtctgtctttcccaacatcccttcagtttcaataagc

SEQ ID NO: 5228 - DNA, 50 bp, Homo sapiens
ttcaggtgagtgtgcctggaggtggagaactatggttttgataacttggc

SEQ ID NO: 5229 - DNA, 50 bp, Homo sapiens
aaggtgccatgtattgaaagtgtgcgtcaaagaacataaatatcagtgga

SEQ ID NO: 5230 - DNA, 52 bp, Homo sapiens
tgtaattattttctgtatgttcaagaaggtaaaggaaaggacagctatggga

SEQ ID NO: 5231 - DNA, 51 bp, Homo sapiens
atttatttggggttggtcccccctttgggccccccgggttttccctttttt

SEQ ID NO: 5232 - DNA, 50 bp, Homo sapiens
aaccataaaaggcccgtttggttagttttccctgtttcctggtttgggct

SEQ ID NO: 5233 - DNA, 50 bp, Homo sapiens
ttatggggtaactcactttgggcggcacgaagaactccaggcggaagcgt

SEQ ID NO: 5234 - DNA, 50 bp, Homo sapiens
tctctccccatcccaagtcatccagccctttttcctaccctcaataaacc

SEQ ID NO: 5235 - DNA, 50 bp, Homo sapiens
ccccctgatggacttcaaatatgtctcatcaactacagtattaaatgcca

SEQ ID NO: 5236 - DNA, 50 bp, Homo sapiens
cgagaatgcctagggaaaccagctacgcttacaagccagctacgcagccc

SEQ ID NO: 5237 - DNA, 50 bp, Homo sapiens
ggaaacattggcctgggggtgtcccccaaaagggggccgtttttaaaggg

SEQ ID NO: 5238 - DNA, 50 bp, Homo sapiens
tgggttgacattgttcgcacggggtgtttcttatattaaaaagactcact

SEQ ID NO: 5239 - DNA, 50 bp, Homo sapiens
ctttccacaaaataatcgataaccttgggggattgttttatggcttgaca

SEQ ID NO: 5240 - DNA, 50 bp, Homo sapiens
ccgccttggggagacaggtcttgattgtctttttcccagtgaacattgtt

SEQ ID NO: 5241 - DNA, 50 bp, Homo sapiens
tcccagactttcaggaaagtaactgtagcactgttaatatcacaacaaca

SEQ ID NO: 5242 - DNA, 50 bp, Homo sapiens
ttttagctgggagtggggggactatggggaataactttccttcatttaat

SEQ ID NO: 5243 - DNA, 50 bp, Homo sapiens
acatgtgtgtgttttccatgaggcactgctttttatgcatttccctcccc

SEQ ID NO: 5244 - DNA, 50 bp, Homo sapiens
ctgtatttgaagtcagcagggctcagcaggatttgaccgacagttacctc

SEQ ID NO: 5245 - DNA, 50 bp, Homo sapiens
tggtttatagatgcacttcctttcataggcagtccctggcactttcttgc

SEQ ID NO: 5246 - DNA, 50 bp, Homo sapiens
aggagctggtattattggagggtattatagatccagtgtattgtgactgt

SEQ ID NO: 5247 - DNA, 50 bp, Homo sapiens
gcagtagtgctaaggcgtcttttgtaggctttagattttgtcgttatggc

SEQ ID NO: 5248 - DNA, 50 bp, Homo sapiens
gcttgtcagaacagaagatatttccaccctgcctagtagatgtgtttcag

SEQ ID NO: 5249 - DNA, 50 bp, Homo sapiens
cccccgttttaggttagggccttgggcaggggtttgccccctgttacccc

SEQ ID NO: 5250 - DNA, 50 bp, Homo sapiens
ttggttttatttatccaaaactgagccttctcataggctttacacccgga

SEQ ID NO: 5251 - DNA, 50 bp, Homo sapiens
ggcaggctctagccaccctgtcggttcccaataagccatttattgaataa

SEQ ID NO: 5252 - DNA, 50 bp, Homo sapiens
tttttgaccagtctacatttcgtatctgtgggatctgcatttgtgaattc

SEQ ID NO: 5253 - DNA, 50 bp, Homo sapiens
tctggacaatgttgatgctaaccttgatgatatccatccctattactggg

SEQ ID NO: 5254 - DNA, 50 bp, Homo sapiens
aggacatgaaggtctgaaaaagaaacaggaaaatacagacatccccgctt

SEQ ID NO: 5255 - DNA, 50 bp, Homo sapiens
aagtcaaggaaccctctcgggtctctgagatccaggccaacagtaaacag

SEQ ID NO: 5256 - DNA, 51 bp, Homo sapiens
agggggctttaaaatttaaaaattgccttttgttttaaaaaaggcccatgt

SEQ ID NO: 5257 - DNA, 50 bp, Homo sapiens
ccccctcccacccaaagaaaaagaaatggtaactacctggacaaaacatt

SEQ ID NO: 5258 - DNA, 50 bp, Homo sapiens
cccttggctcttattgttcttgctggtgtggtatgttcccggctgaaaaa

SEQ ID NO: 5259 - DNA, 50 bp, Homo sapiens
ttccccttttttcccccttttttaaaaagccccttttttaaatggggcgc

SEQ ID NO: 5260 - DNA, 50 bp, Homo sapiens
aaggacagcttgcttgctgatgaacacttccacagtcttttgagctaagt

SEQ ID NO: 5261 - DNA, 51 bp, Homo sapiens
acatgagaattaaccatgtccagtagttaagttcattttcctacagtgtgc

SEQ ID NO: 5262 - DNA, 50 bp, Homo sapiens
gccagaatggtacagagtggagggtgttctgctaatgacttcagagaagt

SEQ ID NO: 5263 - DNA, 50 bp, Homo sapiens
gcacaacttctgggaatctagtggctgtatgttaaagcatcggtaaaaga

SEQ ID NO: 5264 - DNA, 50 bp, Homo sapiens
aaaaaggccccttgtttgttggtttttggcccgttggggaaaatgcctgt

SEQ ID NO: 5265 - DNA, 50 bp, Homo sapiens
tttaggagctgaccatacatgatgagtgatacagcctgtactttgctcat

SEQ ID NO: 5266 - DNA, 50 bp, Homo sapiens
ggtttcccacgaacgggaggctgctgaagagtcaaagcctgggcagactc

SEQ ID NO: 5267 - DNA, 50 bp, Homo sapiens
caggtcatgagtattccaagctcaggtggtgagtcctcctcaccgggatg

SEQ ID NO: 5268 - DNA, 50 bp, Homo sapiens
aaagggaaactggctctggcaccacctactggagaccaaacttcaccaaa

SEQ ID NO: 5269 - DNA, 50 bp, Homo sapiens
gacaaaatagttacctatgctttccttctggcaccccgaatgtacgcagg

SEQ ID NO: 5270 - DNA, 50 bp, Homo sapiens
atctgacctgagggagatcacaaatgccttctgtattgggtggtaatgat

SEQ ID NO: 5271 - DNA, 50 bp, Homo sapiens
tccgttgtaacacatctaatgtgaacgcattataaacatggacctgtact

SEQ ID NO: 5272 - DNA, 51 bp, Homo sapiens
acataactattccgttgatgaatagcatcaggacttaaatggtgaccttgt

SEQ ID NO: 5273 - DNA, 51 bp, Homo sapiens
aacgggtttgggtttgggggggtttgttctttttattgaatccatttaagt

SEQ ID NO: 5274 - DNA, 50 bp, Homo sapiens
tataggagatgggatactcattcccgctgctattgataaggtcggaggcg

SEQ ID NO: 5275 - DNA, 50 bp, Homo sapiens
cagaacgtcctcaaggacacactcctccctcgggcctcactctggagcac

SEQ ID NO: 5276 - DNA, 50 bp, Homo sapiens
ctggacatgttgtttccatgttcagtcccttcccggtttttgggtgtttt

SEQ ID NO: 5277 - DNA, 50 bp, Homo sapiens
aaagtagccatcctgagtctccagggtgatgagcggacttgggtgtggat

SEQ ID NO: 5278 - DNA, 50 bp, Homo sapiens
ccttccatctcatcggtggcctctcactgtggctcactgtttaacacatg

SEQ ID NO: 5279 - DNA, 50 bp, Homo sapiens
tgttcaaggtcacatagtttaggtaagaagctcaaacctgagttttaggt

SEQ ID NO: 5280 - DNA, 50 bp, Homo sapiens
cacctgattccccctcttgcccacaggactctgctgttgttttcattctg

SEQ ID NO: 5281 - DNA, 50 bp, Homo sapiens
tctcgtgaggtgatgtggtgctgcagacttaagctatctgccttgaagat

SEQ ID NO: 5282 - DNA, 50 bp, Homo sapiens
aacaagcctggaataatgcccccaaagattgagtggaaatcgcccctttt

SEQ ID NO: 5283 - DNA, 50 bp, Homo sapiens
caggaccagatggcccaggaggaagtggatgctttcttggtagggaatgg

SEQ ID NO: 5284 - DNA, 50 bp, Homo sapiens
cctcctgctagaagacagatttcttccttggctgacaggctgaattaagc

SEQ ID NO: 5285 - DNA, 50 bp, Homo sapiens
aatttccaaaaacaaaacaaaacaagcaggtttcatggagcccgagtcca

SEQ ID NO: 5286 - DNA, 50 bp, Homo sapiens
cctttatgcaagttgtaaggggttgaccagtaaagaggaagttttgcccc

SEQ ID NO: 5287 - DNA, 50 bp, Homo sapiens
agtattagctacaaacaagccttgtttcctcttggctgtcaggcactgct

SEQ ID NO: 5288 - DNA, 50 bp, Homo sapiens
aagccccagtaaggtgttcaggactggtaaacgactgtcctcaagtaagg

SEQ ID NO: 5289 - DNA, 50 bp, Homo sapiens
tggttcaggtagtaaatgcttttggtcacatcagaactctagatctgggg

SEQ ID NO: 5290 - DNA, 50 bp, Homo sapiens
gcctgggctgtttttgctatatgtaaataaagcccttgggtctttatttt

SEQ ID NO: 5291 - DNA, 50 bp, Homo sapiens
ggaggttaggaagcccttttaaagtacaaacccccggcatggggaatttt

SEQ ID NO: 5292 - DNA, 50 bp, Homo sapiens
aacgggagtgatcgggaagtgaacagtttcatcatctgctgctgctattc

SEQ ID NO: 5293 - DNA, 50 bp, Homo sapiens
ctggtatgttgctttgtaggggaaaaactaattttgttgggtcagggaca

SEQ ID NO: 5294 - DNA, 50 bp, Homo sapiens
ccggacaagccatttgatgttctagtttgcaattactccacgcaaagtgg

SEQ ID NO: 5295 - DNA, 50 bp, Homo sapiens
tttgggcatcaacttcaacaactactaccaggacgcctgagggtgctttt

SEQ ID NO: 5296 - DNA, 50 bp, Homo sapiens
tcgaagaaagtacctgtaaatgtagagtaattgcgaagctgtcaggaata

SEQ ID NO: 5297 - DNA, 50 bp, Homo sapiens
tcctagaccctgcattgtgaaatggggcttgaattttagttctgaatttt

SEQ ID NO: 5298 - DNA, 50 bp, Homo sapiens
ctaaagcagtgtctgacctggatttgctgccaatttgtaagctttcatga

SEQ ID NO: 5299 - DNA, 50 bp, Homo sapiens
ggagctgagcagggatgcaaaaccatccagtctgtaagattcacagagac

SEQ ID NO: 5300 - DNA, 50 bp, Homo sapiens
aaacggtgtttgagctgctttgggaaaacccatgttgcagattttcaggt

SEQ ID NO: 5301 - DNA, 50 bp, Homo sapiens
cagagctgtgtttcctcaacaagtgtgcgagcggtcgtgtgcgccatgag

SEQ ID NO: 5302 - DNA, 50 bp, Homo sapiens
aaatcgcttctgtattgttaatagcaatatatgacctctgctgtcctcct

SEQ ID NO: 5303 - DNA, 50 bp, Homo sapiens
gaaaggataatttcgaacccttgcatagtttcggtatgggccgtgccaac

SEQ ID NO: 5304 - DNA, 50 bp, Homo sapiens
ccctcttgaactgcactgcctaagaaatgttggttgcatggagacatatt

SEQ ID NO: 5305 - DNA, 50 bp, Homo sapiens
tctgccttatttggcttggaagagaaaccgataaacactcccgtgctagt

SEQ ID NO: 5306 - DNA, 50 bp, Homo sapiens
aaacagcagaaaagtaatttctggtgaactgatgagaattccctattgca

SEQ ID NO: 5307 - DNA, 50 bp, Homo sapiens
aggttgttttggaaaaattatttgttttgtcctaaggggtcctgcccacc

SEQ ID NO: 5308 - DNA, 52 bp, Homo sapiens
cctccggaacgtttttaaaaaggaaaaagcccgggttttcccttgggaaaaa

SEQ ID NO: 5309 - DNA, 50 bp, Homo sapiens
cagacctgtgggctgattccagactgagagttgaagttttgtgtgcatca

SEQ ID NO: 5310 - DNA, 50 bp, Homo sapiens
accaagtttgaatttgtcaaatcccaagtcaatccaggatgttcatttct

SEQ ID NO: 5311 - DNA, 50 bp, Homo sapiens
agtgatctgcctttcagcaactgtcttattttggttctttgaaactgtga

SEQ ID NO: 5312 - DNA, 50 bp, Homo sapiens
tttgaatggctgaagctaaggcaacgttagtttctccttactctgctttt

SEQ ID NO: 5313 - DNA, 50 bp, Homo sapiens
acctttgtgattctgtctagtgaaaatgggacatttttaatagtgccaga

SEQ ID NO: 5314 - DNA, 50 bp, Homo sapiens
gaacttgcccctaaactgggttaaatggaccctgttgagttttctggaca

SEQ ID NO: 5315 - DNA, 50 bp, Homo sapiens
taaattgggcaaagttttttatggaatttccggggcaaggttttgggggc

SEQ ID NO: 5316 - DNA, 50 bp, Homo sapiens
aaatctcatttgcaagttctcccattaagcaagggagtagtttactagga

SEQ ID NO: 5317 - DNA, 50 bp, Homo sapiens
aagaaaggcccataacagatggcaaaatagaggattggtgagggatatgc

SEQ ID NO: 5318 - DNA, 50 bp, Homo sapiens
aaaaccattccagcttaatgcctttaattttaatgccaacaaaattgggg

SEQ ID NO: 5319 - DNA, 50 bp, Homo sapiens
tgcaaccttcttaaaatgtgggctactggagatcatgccactgcactcca

SEQ ID NO: 5320 - DNA, 50 bp, Homo sapiens
agctcagatgggtccccaaaagaggcataggaaagcgcgacctcactgcc

SEQ ID NO: 5321 - DNA, 50 bp, Homo sapiens
caaataaaaaggctggggccaaaggtgggcaccaaaagtcctcctatgtg

SEQ ID NO: 5322 - DNA, 50 bp, Homo sapiens
tgcagctcccatttcctgagcgtctaccaggtactaggagaactcttaca

SEQ ID NO: 5323 - DNA, 50 bp, Homo sapiens
attatccttttccccaggaagccctcggcccccaaaaagggaaacagttt

SEQ ID NO: 5324 - DNA, 50 bp, Homo sapiens
catgagcccaggggtttcatgacaaacattactagcatgttcaactgccc

SEQ ID NO: 5325 - DNA, 50 bp, Homo sapiens
gcccggtttatggaaaaaccaggaccagtttatgtttggggttttgggaa

SEQ ID NO: 5326 - DNA, 50 bp, Homo sapiens
gcttggtactgtcatagtgattacaaatttcatggaatgcgaagagcaac

SEQ ID NO: 5327 - DNA, 50 bp, Homo sapiens
ttttctcccctctcttccccttccacgaactgcaataccagtaaccttgg

SEQ ID NO: 5328 - DNA, 50 bp, Homo sapiens
aagcccagatacacaaaattccaccccatgatcaagaatcctgctccact

SEQ ID NO: 5329 - DNA, 50 bp, Homo sapiens
catgtgttgactctgtaatggatttatgtagcccacttcagtctgcaaat

SEQ ID NO: 5330 - DNA, 50 bp, Homo sapiens
aggggtgtcccttttccccttcatgtaaaattctaactggggctaccagt

SEQ ID NO: 5331 - DNA, 50 bp, Homo sapiens; identical to SEQ ID NO: 4387

SEQ ID NO: 5332 - DNA, 50 bp, Homo sapiens
tgaagaaactgccctttctgtgatgtttttgaatactacccaacagccaa

SEQ ID NO: 5333 - DNA, 50 bp, Homo sapiens
cttcctagccctaagtttggcctttgggtggctccaaaaaggattaggtt

SEQ ID NO: 5334 - DNA, 50 bp, Homo sapiens
tccccctcgttttgtagggtttgtacataataaaacaatggggtggggcc

SEQ ID NO: 5335 - DNA, 50 bp, Homo sapiens
tgttaagtgtgaggttttctgaacccttagcagaaggacttttaatgttt

SEQ ID NO: 5336 - DNA, 50 bp, Homo sapiens
agttccactgctgttcctcttaccttgattaaatgcctatgcatgtactt

SEQ ID NO: 5337 - DNA, 50 bp, Homo sapiens
agttctgttgtgtaatctggtgctggttccctgggcatatgtattctgtg

SEQ ID NO: 5338 - DNA, 50 bp, Homo sapiens
cccccttgcttggttttaagtaggtatggaatgttattataggccatagt

SEQ ID NO: 5339 - DNA, 50 bp, Homo sapiens
tcagtgtaaacataattaggccgtgagtttttgctcttactcccaggttt

SEQ ID NO: 5340 - DNA, 50 bp, Homo sapiens
tgtaaacttgttttaacaactcttttcaacattttggccggggtattccc

SEQ ID NO: 5341 - DNA, 50 bp, Homo sapiens
tgctgaaagtggtcccaaaggggtactagtttttaagctcccaactcccc

SEQ ID NO: 5342 - DNA, 50 bp, Homo sapiens
ttcccagttgccacagaccgtttatatgaagaaatgctaaagaagttccc

SEQ ID NO: 5343 - DNA, 50 bp, Homo sapiens; identical to SEQ ID NO: 4387

SEQ ID NO: 5344 - DNA, 51 bp, Homo sapiens
agttctaaagccgggaattcctaaggatatactaaatgagattatgtgtgg

SEQ ID NO: 5345 - DNA, 50 bp, Homo sapiens
gcctgggggaggagaagtcccttcccattccagctcgatcaatcttgctg

SEQ ID NO: 5346 - DNA, 50 bp, Homo sapiens
ggagtagagagagtcttgctacatgcgggaactagaattacatcactgcg

SEQ ID NO: 5347 - DNA, 50 bp, Homo sapiens
aagaagtttcattgatatccactggtcacatcatacctgtctatagggca

SEQ ID NO: 5348 - DNA, 50 bp, Homo sapiens
tgcttcaagcacaggatttatggaatagttggcaaattaaacaacatgct

SEQ ID NO: 5349 - DNA, 50 bp, Homo sapiens
cggcagccttatggaatgagtttcttgtcatgaatgttgtccccaaagct

SEQ ID NO: 5350 - DNA, 50 bp, Homo sapiens
acagttactttggagctgctagactggttttctgtgttggtaaattgcct

SEQ ID NO: 5351 - DNA, 50 bp, Homo sapiens
tgtgaagaatccctaccattaataccctgggtgggataaataaaaatggg

SEQ ID NO: 5352 - DNA, 50 bp, Homo sapiens
cccaaaatttgtttaaagttccgacttccaaaaggggccaataaaaaggg

SEQ ID NO: 5353 - DNA, 51 bp, Homo sapiens
caccgcctctgcctccgcctcttccactggagagcccgaggtcaaaaggtc

SEQ ID NO: 5354 - DNA, 50 bp, Homo sapiens
ccctcacctagcagtactaccacaataatgctatcatggtgccagggaat

SEQ ID NO: 5355 - DNA, 50 bp, Homo sapiens
tctccttccccattgggccgcctttatcaattgcctgttttgttttgttt

SEQ ID NO: 5356 - DNA, 50 bp, Homo sapiens
tttttatctttcttggtgggggtgtggtggtggtgaagaggacctaaaaa

SEQ ID NO: 5357 - DNA, 50 bp, Homo sapiens
cgccagaggtcagaacatgtctattttgaattggatcgttacaaatgagc

SEQ ID NO: 5358 - DNA, 50 bp, Homo sapiens
gcaggcactgacatttttgagcaaagacgtgatgttatgagataaatatc

SEQ ID NO: 5359 - DNA, 50 bp, Homo sapiens
ttctgacacgattacacaacgaggctttaatgccatttgggtaggtgagc

SEQ ID NO: 5360 - DNA, 51 bp, Homo sapiens
ttttaaaggggaggggccggggtttggtccccggtcccaaaggtaaaagtt

SEQ ID NO: 5361 - DNA, 50 bp, Homo sapiens
gagtgagaagaggcttttaaggaccatgtgaagaggcttttaaacacttt

SEQ ID NO: 5362 - DNA, 50 bp, Homo sapiens
gggttgggataaactgcttagatgtttgcctacttgtccagtgaaattac

SEQ ID NO: 5363 - DNA, 50 bp, Homo sapiens
actgaaaagttgaaagacttttgcagtgaacatttatataactccccgct

SEQ ID NO: 5364 - DNA, 50 bp, Homo sapiens
attcataggtagtgcccagagagagtacaagctctgactcatatggcagt

SEQ ID NO: 5365 - DNA, 50 bp, Homo sapiens
acatgttacctggagtagctgtgtcaacagattaatatggaatgctacta

SEQ ID NO: 5366 - DNA, 50 bp, Homo sapiens
tggttcctgtgctcaccatagggctggtgtacattgggccattaataaac

SEQ ID NO: 5367 - DNA, 50 bp, Homo sapiens
acagatccctattgccagacacatcattctctccatccagaaagcaaaca

SEQ ID NO: 5368 - DNA, 50 bp, Homo sapiens
tctgggaaagacatttttaagctgctgacttcacctgcaaaatctaacag

SEQ ID NO: 5369 - DNA, 50 bp, Homo sapiens
agtcacgataaacctggtcacctgaaaattgaaattgagccacttccttg

SEQ ID NO: 5370 - DNA, 50 bp, Homo sapiens
aaactggcggcccaacaaaacagtgggttaaatgggtccctgggtgacat

SEQ ID NO: 5371 - DNA, 50 bp, Homo sapiens
agtgtttcctccacatctaaagaaagcccattttgaaactggatactgca

SEQ ID NO: 5372 - DNA, 50 bp, Homo sapiens
cccaggtggcccctctccatcagatgttattgctcttccccatttattta

SEQ ID NO: 5373 - DNA, 50 bp, Homo sapiens
aagatgcctaagcgttaaccaggtgaaacaggggtgggagagagaaagaa

SEQ ID NO: 5374 - DNA, 50 bp, Homo sapiens
gtcatacacctatcccccattttcctcctatccctcaacccggacatcat

SEQ ID NO: 5375 - DNA, 50 bp, Homo sapiens
gcaggtggcagaatggggtgcatgaaggtttctgaaaattaacactgctt

SEQ ID NO: 5376 - DNA, 50 bp, Homo sapiens
acagagaggcagcatttgttttccagttaaaatttgacctcactgtgatt

SEQ ID NO: 5377 - DNA, 50 bp, Homo sapiens
cccccttttgttgtggttttatattggaaccccctttttctttggaacta

SEQ ID NO: 5378 - DNA, 50 bp, Homo sapiens
ctgaccccttcctcacccctgccaacagtggtggcatatatcacaaatgg

SEQ ID NO: 5379 - DNA, 50 bp, Homo sapiens
tgttttacctcactgttggacatacattccaagcttttcaactctaggag

SEQ ID NO: 5380 - DNA, 50 bp, Homo sapiens
cagaacatgcccaaagaagcctatatcttgctgctgggaaatgtaaagca

SEQ ID NO: 5381 - DNA, 50 bp, Homo sapiens
caaacaccggcagttgaaaggaaaaggacggggaatgtgatggaaaagag

SEQ ID NO: 5382 - DNA, 50 bp, Homo sapiens
ccccctccctgccccggtgagctttggggaacccaaaaattagattttgc

SEQ ID NO: 5383 - DNA, 50 bp, Homo sapiens
cccaaatccaaggaccaatgctgttgtaaacaaggggtaaagggcctaaa

SEQ ID NO: 5384 - DNA, 50 bp, Homo sapiens
actccaccaagactgtgaactccaccggggtaggaagcatattttactca

SEQ ID NO: 5385 - DNA, 50 bp, Homo sapiens
gagaactcgtttcaaggaactcgatgtttccggggaccaagcccgcccag

SEQ ID NO: 5386 - DNA, 50 bp, Homo sapiens
ccagcgaatttccagcttttgaaactcagatttccttttgcgacccaggt

SEQ ID NO: 5387 - DNA, 50 bp, Homo sapiens
gatgcgcggcaagaatgtacctgtagatgtgtacataccacagtgctgta

SEQ ID NO: 5388 - DNA, 50 bp, Homo sapiens
tttatctcagaatcttgatgaactctgaaatgacccctgatgggggcatg

SEQ ID NO: 5389 - DNA, 50 bp, Homo sapiens
ggccccctgtccttacctgttttcggcccccttaattttttaaccccggg

SEQ ID NO: 5390 - DNA, 50 bp, Homo sapiens
gtcacagtgtagacacatggtgcttccatagtgagtagaatatccattgt

SEQ ID NO: 5391 - DNA, 50 bp, Homo sapiens
gtggcctggcctggctctcacagacccaaggcttccgtgtagaatatgtc

SEQ ID NO: 5392 - DNA, 50 bp, Homo sapiens
ggattgtggcaggaactgtttcccctcccagccttaaatttttctgtgtt

SEQ ID NO: 5393 - DNA, 50 bp, Homo sapiens
aaacccacacctcagtgaatttaaaagagtagatgttttaaaagaccgga

SEQ ID NO: 5394 - DNA, 51 bp, Homo sapiens
tgccatttggtattttttcctgaaacattacataataagaatgcagcatgc

SEQ ID NO: 5395 - DNA, 50 bp, Homo sapiens
gcctgaaaccatcctgccttctaggaagacagcaattctggaagagcaag

SEQ ID NO: 5396 - DNA, 50 bp, Homo sapiens
ggtggttccccagcccttttccctggccctgggttggaaaatttgttttc

SEQ ID NO: 5397 - DNA, 51 bp, Homo sapiens
aaaacctttcgcccggcttaaaatttaccggggtttggttttatttggttt

SEQ ID NO: 5398 - DNA, 50 bp, Homo sapiens
ctccttggtgtcatgcaactgaggaacctaattggctgggtgggttgttc

SEQ ID NO: 5399 - DNA, 50 bp, Homo sapiens
gtttgtaaaagaacctgccacatttgttgaaaagttagagccatcacagc

SEQ ID NO: 5400 - DNA, 50 bp, Homo sapiens
ctcttggctgctggccttttgttcttgtcatggctcattagctccctaaa

SEQ ID NO: 5401 - DNA, 50 bp, Homo sapiens
ccaggggtttttaaattttctgaagtttttggggccattttggttgttgg

SEQ ID NO: 5402 - DNA, 50 bp, Homo sapiens
ccccgcttgccttttatttcagaaccccaagtattacccaatatgttaca

SEQ ID NO: 5403 - DNA, 50 bp, Homo sapiens
gccgaagctcacagaggctaagttacacgcttaggtgttcttattcctac

SEQ ID NO: 5404 - DNA, 50 bp, Homo sapiens
aaccaggtttatgatgctgtaataaaccatggcattaaagagggcaagag

SEQ ID NO: 5405 - DNA, 50 bp, Homo sapiens
gggttaaggagggccgctccaaaattttcctttttcccaggaagcccttg

SEQ ID NO: 5406 - DNA, 50 bp, Homo sapiens
atgctgtgagtggtacacatggctgaggttatgatctgttaaaatatgta

SEQ ID NO: 5407 - DNA, 50 bp, Homo sapiens
ttcattaattcctcaacccaatactgtctggcttccaccaacaggagcgg

SEQ ID NO: 5408 - DNA, 50 bp, Homo sapiens
tggtttctattttaaaaacctgggttaggccaaggtttggggttcgccct

SEQ ID NO: 5409 - DNA, 50 bp, Homo sapiens
caacattgcctaccagttgcagttcattagccccgtccgccccagcattg

SEQ ID NO: 5410 - DNA, 50 bp, Homo sapiens
cctttggggtgggggctttttcctttttggccggttcaattaaggttttt

SEQ ID NO: 5411 - DNA, 50 bp, Homo sapiens
cccactccggctgttttagaagttttcccgaatccgtgatccctttacaa

SEQ ID NO: 5412 - DNA, 50 bp, Homo sapiens
aatgggcaaattttacccaaaacttaagcttgcctattccgtttgaggca

SEQ ID NO: 5413 - DNA, 50 bp, Homo sapiens
gaaggagaggcacacacaaatacacacactcacacaaaactcaacaacca

SEQ ID NO: 5414 - DNA, 50 bp, Homo sapiens
ggataccccctttatcccgagggaatttttaccctttggatgcctttaaa

SEQ ID NO: 5415 - DNA, 50 bp, Homo sapiens
caaattacaaacctaaaaatacagaacatcagcggagaagacaggagagc

SEQ ID NO: 5416 - DNA, 50 bp, Homo sapiens
ctcctcccttgggtgggacctgggttgggggtttgatagaaaaattaacc

SEQ ID NO: 5417 - DNA, 50 bp, Homo sapiens
ggttaaactagatccctgcaaggccatcacctccattccaagttgttact

SEQ ID NO: 5418 - DNA, 50 bp, Homo sapiens
agtgggttattttagatcttttcctggggttcaggtcacatagcttaact

SEQ ID NO: 5419 - DNA, 50 bp, Homo sapiens
tgtttgggtatattgtttgggttttgggcactaggatgggtgactcaggg

SEQ ID NO: 5420 - DNA, 50 bp, Homo sapiens
gccagtgaatctagttttggctattctgtattttgtccagtttttcccat

SEQ ID NO: 5421 - DNA, 50 bp, Homo sapiens
aaccattttcccccgggaacccgttttgcctggtttcggattttttaccc

SEQ ID NO: 5422 - DNA, 50 bp, Homo sapiens
ccgggaagcggggtactggctgtgtttaatcattaaaggtaccgtgtccg

SEQ ID NO: 5423 - DNA, 50 bp, Homo sapiens
tttttccccctcccaaattcactgcattacagtttttgaaacagaacggg

SEQ ID NO: 5424 - DNA, 50 bp, Homo sapiens
tacgagaagtcaggaagttttgaaatggcagtgacaggagacgggggaag

SEQ ID NO: 5425 - DNA, 50 bp, Homo sapiens
aagggcaggcaaatcaattaaaattagccgtaacaacaacctcgggggtg

SEQ ID NO: 5426 - DNA, 50 bp, Homo sapiens
agtacacggccctcaaaagttatatgtgctgaatgtaacctacttagcga

SEQ ID NO: 5427 - DNA, 51 bp, Homo sapiens
ttgttttaacaactcttctcaacattttgtccaggttattcactgtaacca

SEQ ID NO: 5428 - DNA, 50 bp, Homo sapiens
cttctccacctcggccaggtatagggccagcttctcgtctctgggatccg

SEQ ID NO: 5429 - DNA, 50 bp, Homo sapiens
gccaggtcattgtatagggagtaagatgaaggtgaatttgcagctagttg

SEQ ID NO: 5430 - DNA, 50 bp, Homo sapiens
tgtgttttgtttttctggtcccagggcaccgtttgttttgtgaactcctc

SEQ ID NO: 5431 - DNA, 50 bp, Homo sapiens
catggctctaaaatttggaattaacttctcttgccttaagagctgcttgt

SEQ ID NO: 5432 - DNA, 50 bp, Homo sapiens
gctggtgggaagttgagccatgtttatctctagtggaatccttaccttgt

SEQ ID NO: 5433 - DNA, 50 bp, Homo sapiens
catgtttacacaaattccttcaaagccccttaaacatggggccgggcccc

SEQ ID NO: 5434 - DNA, 50 bp, Homo sapiens
accctaatagctaggctgggtatattttcaaagtgtagcgaaaccccacg

SEQ ID NO: 5435 - DNA, 50 bp, Homo sapiens
cagttggcctcctacaattgggaattctaccaagctccaagttgacctgg

SEQ ID NO: 5436 - DNA, 50 bp, Homo sapiens
ggattcccgacaaaggcttgatgtgtacttgaagtgagcaaagggttttg

SEQ ID NO: 5437 - DNA, 50 bp, Homo sapiens
gggtgggagacaggctaatcctttccccttgttttccacgtctttatgac

SEQ ID NO: 5438 - DNA, 51 bp, Homo sapiens
acaaccttcttaatatattagagacccgcaggaaacatttagtggtgaaac

SEQ ID NO: 5439 - DNA, 51 bp, Homo sapiens
gtacatgtttgtgtgctaaattgctcatttggcagtgatagattgaaaaac

SEQ ID NO: 5440 - DNA, 50 bp, Homo sapiens
gggggtcaaagagggtacaaatgtatgggggtatattgaatgctaaacat

SEQ ID NO: 5441 - DNA, 50 bp, Homo sapiens
gggagcccgttttagaaggaagggcaaaagtagggtttttaacccaaacg

SEQ ID NO: 5442 - DNA, 50 bp, Homo sapiens
tccgtcccattcccccggaaaacaaggttttgaattggcccgtaaaaggg

SEQ ID NO: 5443 - DNA, 50 bp, Homo sapiens
acgtccttatacaatgcactgtttgatttttaaacaatacctgaagggct

SEQ ID NO: 5444 - DNA, 50 bp, Homo sapiens
actcaatactcgggaaaggcttcacatttctgggactcagcattatccaa

SEQ ID NO: 5445 - DNA, 50 bp, Homo sapiens
ttgagaggcaacacttaaacactagggctactgtggcatctatgtagaca

SEQ ID NO: 5446 - DNA, 50 bp, Homo sapiens
agccctttcttgttgctgtatgtttagatgctttccaatcttttgttact

SEQ ID NO: 5447 - DNA, 50 bp, Homo sapiens
ggggtatggtttagtaatatccaccagaccttccgatccagcagtttggt

SEQ ID NO: 5448 - DNA, 50 bp, Homo sapiens
aacaacaacagcaaaatccccttagtgcgtaacttgaaattcccttcggc

SEQ ID NO: 5449 - DNA, 50 bp, Homo sapiens
ttgtaagtgggtgcataagaagatctcttcaattaaatgcccccgctggt

SEQ ID NO: 5450 - DNA, 50 bp, Homo sapiens
ataattaagaaatcagccgtgtgcttctcacgtttgggctccgagacgtg

SEQ ID NO: 5451 - DNA, 50 bp, Homo sapiens
gtcagtctcctcacctgcctctgctcctcgcttagcccattgattgcatc

SEQ ID NO: 5452 - DNA, 50 bp, Homo sapiens
gggaagaagcccgtgcccccacccaataaatgttggttttggccctgatg

SEQ ID NO: 5453 - DNA, 50 bp, Homo sapiens
cagaacttctggcgaaggccatgtaagaactactccaaggaggaagaggc

SEQ ID NO: 5454 - DNA, 50 bp, Homo sapiens
ctctaccataaggcactatcagagactgctactggagtgtatatttggtt

SEQ ID NO: 5455 - DNA, 50 bp, Homo sapiens
actgctacagcttaaccattgttccaagctaattaaattacctttgggga

SEQ ID NO: 5456 - DNA, 50 bp, Homo sapiens
caattgtgatttggaaggtttaactgggtctgcccagatgtttacgaata

SEQ ID NO: 5457 - DNA, 50 bp, Homo sapiens
tccaagcaaaagttatgcaataagacagaatataaagtctccgagagcct

SEQ ID NO: 5458 - DNA, 50 bp, Homo sapiens
gggtggggtggggtgagagtgtgtggagtaaggaccttcagaattaatat

SEQ ID NO: 5459 - DNA, 51 bp, Homo sapiens
tgcagttcttattttcttttgcctgtgataattgcaaatccgtcaatagaa

SEQ ID NO: 5460 - DNA, 50 bp, Homo sapiens
tgcaagtttctgagactgtgaaaagtgttttgcttcttttgttacccaat

SEQ ID NO: 5461 - DNA, 50 bp, Homo sapiens
tcccagcgaatgtgaatcatttagtgtgctactcaaaattaggtgtccac

SEQ ID NO: 5462 - DNA, 50 bp, Homo sapiens
taagatgtaggggccaccggccagcagtacccagcaatgaccactatcag

SEQ ID NO: 5463 - DNA, 50 bp, Homo sapiens
ataaatgaaagcataccaagtgctgtccattccataggtacaactatgga

SEQ ID NO: 5464 - DNA, 50 bp, Homo sapiens
ctggtattctgaggtcagatgtaggctgttgctcgctccggctgggtctc

SEQ ID NO: 5465 - DNA, 50 bp, Homo sapiens
ccatcgggggtattggggttttgggctgaatttacttgattattggaaaa

SEQ ID NO: 5466 - DNA, 50 bp, Homo sapiens
gccagattgtggcaggtaaagagacaatgtaatttgcactccctatgata

SEQ ID NO: 5467 - DNA, 50 bp, Homo sapiens
tttaaaaaggagggaggatttctgggttaaaacttttatttggcccccat

SEQ ID NO: 5468 - DNA, 50 bp, Homo sapiens
taaaacccaagacttcagattcagccgaattgtggtgtttcacaaggccg

SEQ ID NO: 5469 - DNA, 50 bp, Homo sapiens
ctaagcatggggaagggggcagagtgaggactgtgccattgattaaagtg

SEQ ID NO: 5470 - DNA, 50 bp, Homo sapiens
gtacagaaacatattccatgctttgaaataaagggaagtgctctcctgtt

SEQ ID NO: 5471 - DNA, 50 bp, Homo sapiens
gaagccttttcttttctgttcaccctcaccaagagcacaacttaaatagg

SEQ ID NO: 5472 - DNA, 51 bp, Homo sapiens
accgatcgtttttaggataatatgcatgtttcaagtggtattgaaaccccc

SEQ ID NO: 5473 - DNA, 50 bp, Homo sapiens
tgagggacaggctgcctaaagtctaattggagagttaacctaatgtctgt

SEQ ID NO: 5474 - DNA, 50 bp, Homo sapiens
caccatcgtggctctgagaactgacgccgtgaatgttgacctgagtgccg

SEQ ID NO: 5475 - DNA, 50 bp, Homo sapiens
ggggagagaccaccctagacatttgcatttttgtaagttagccagccaat

SEQ ID NO: 5476 - DNA, 50 bp, Homo sapiens
tggataaatctgagcaactttcttctttgtgctccaggaacctacgcact

SEQ ID NO: 5477 - DNA, 50 bp, Homo sapiens
tgtgggttttgattgacatactgttgttcatgctgaagtttgagtgtcgt

SEQ ID NO: 5478 - DNA, 50 bp, Homo sapiens
ggtgtgcagtccgcctgaaagccttccctttagctattaggaattgagtc

SEQ ID NO: 5479 - DNA, 53 bp, Homo sapiens
acattggaaagaaaccctacaactgtaatgaatatgaaaagaattgtctaaaa

SEQ ID NO: 5480 - DNA, 50 bp, Homo sapiens
aaaaccgttttccccatacataaagaacaggggtactcccgccctgatgg

SEQ ID NO: 5481 - DNA, 50 bp, Homo sapiens
tttggtgaagtgaaagagagaagttgctctaaaaggttggaaaccagccc

SEQ ID NO: 5482 - DNA, 50 bp, Homo sapiens
tggactgttgtaatgttttgcgttatcaaaatgaaaactgccaaatgaga

SEQ ID NO: 5483 - DNA, 50 bp, Homo sapiens
gctttgagttttgggatggtcacatgacacaatccagcacttgaacctga

SEQ ID NO: 5484 - DNA, 50 bp, Homo sapiens
agagccattcccacaaagtaaatgtgcagtgcccatgtttcttgtgttta

SEQ ID NO: 5485 - DNA, 50 bp, Homo sapiens
gactctgagagagagcgacggccatcatagaacagcgaaggcagtcgatc

SEQ ID NO: 5486 - DNA, 50 bp, Homo sapiens
atcgatgagaagagtctgcaaaacacttcatcctcaggacgtgctgtcct

SEQ ID NO: 5487 - DNA, 50 bp, Homo sapiens
atatattaaaccacaggtattagagacatgaattgcacccaacacaagct

SEQ ID NO: 5488 - DNA, 50 bp, Homo sapiens
attcattcgggtcttcctttcttccgcccccttccttccattggcacctc

SEQ ID NO: 5489 - DNA, 50 bp, Homo sapiens
tcagttttgtggaatctggtgtttgcactataggttaagagttgccattt

SEQ ID NO: 5490 - DNA, 50 bp, Homo sapiens
tgtgtggtgggggtgcttttgaggttggaggaaagtagagacagcgaaac

SEQ ID NO: 5491 - DNA, 50 bp, Homo sapiens
tgtgctttttgcccaagtggtaattcatcttggtttgctatgttaaaact

SEQ ID NO: 5492 - DNA, 50 bp, Homo sapiens
ctttggggacctaaaccccaggtggtctcttggtgttaataatgctggaa

SEQ ID NO: 5493 - DNA, 50 bp, Homo sapiens
aaatcgcggtcgccttaatccaagcctaggttttcacacttttagtaagc

SEQ ID NO: 5494 - DNA, 50 bp, Homo sapiens
tggggcactttgaaaacttcacaggcccactgctgcttgctgaaataaaa

SEQ ID NO: 5495 - DNA, 50 bp, Homo sapiens
gacattcatctgtttccactgagtctgagtcttcaagttttcactccagc

SEQ ID NO: 5496 - DNA, 50 bp, Homo sapiens
tggcgaggataaatagaggcattgtttttgctactttgcatatcattggc

SEQ ID NO: 5497 - DNA, 50 bp, Homo sapiens
tggctctcctctttgtaatatacagggtgaactctttactgatacacaca

SEQ ID NO: 5498 - DNA, 50 bp, Homo sapiens
ccagtgtcctgcatgggtgctaggctgaattatttgtaattgtgcttagg

SEQ ID NO: 5499 - DNA, 50 bp, Homo sapiens
accgtcttttgtgattccctggaaacccttaattcaatagtcctgactga

SEQ ID NO: 5500 - DNA, 50 bp, Homo sapiens
agccctgggtagccaagtgattttcccattcccaaagttagtaaaccttt

SEQ ID NO: 5501 - DNA, 50 bp, Homo sapiens
gcaggaaagatggggtggtggactgtttttgcctactttttgtttttgaa

SEQ ID NO: 5502 - DNA, 50 bp, Homo sapiens
ccccctgaaactggcattttgtaaatgtggtttgactatttttgtatgtt

SEQ ID NO: 5503 - DNA, 50 bp, Homo sapiens
acctggagaattccctaaggccaaagcaaggtaacagggacttcagtttt

SEQ ID NO: 5504 - DNA, 50 bp, Homo sapiens
gcctcagtacaaagggggctttggaagtgtttgttggctgaataaaggaa

SEQ ID NO: 5505 - DNA, 50 bp, Homo sapiens
acccatgccaattgaagaacgtgttaaagatgaggaggagagatgtacca

SEQ ID NO: 5506 - DNA, 50 bp, Homo sapiens
gcacattccttccttatatcctggaagcacccagatattcttcatgtccc

SEQ ID NO: 5507 - DNA, 50 bp, Homo sapiens
ttaagtcatctgctgagcagtgtgctgtgtcaacctcctcctaggtaacc

SEQ ID NO: 5508 - DNA, 50 bp, Homo sapiens
cagggtatcagatattgtgccttttggtgccaggttcaaagtcaagtgcc

SEQ ID NO: 5509 - DNA, 50 bp, Homo sapiens
tggtaatagtgtttgactccagggaagaacagatgggtgccagagtgaaa

SEQ ID NO: 5510 - DNA, 50 bp, Homo sapiens
tcaagtataccatttaaaatatttcatcaggcagagccctgaccaggaaa

SEQ ID NO: 5511 - DNA, 50 bp, Homo sapiens
cttttccggttgcccgaggatgcttgggaaggaacccgtctcccttcttc

SEQ ID NO: 5512 - DNA, 50 bp, Homo sapiens
tccccaaacccccttaaaggtttttaaattgtttcaaatctgggcaagtt

SEQ ID NO: 5513 - DNA, 50 bp, Homo sapiens
gactcggagagccaggaggagaacacgcagctctgaactggctgagcgag

SEQ ID NO: 5514 - DNA, 50 bp, Homo sapiens
ctgttgtgaatcatttgtgtccttttcaactgtctttcagaggaaaggta

SEQ ID NO: 5515 - DNA, 50 bp, Homo sapiens
aagaagcaaccacagctaattttagaacatgcactctgacagaaaagaca

SEQ ID NO: 5516 - DNA, 50 bp, Homo sapiens
gcttttgaggacctttctggaggaaaggaaaagcctgttttggggagtct

SEQ ID NO: 5517 - DNA, 50 bp, Homo sapiens
aggctgcatatggattgccaagtcagcatatgaggaattaaagacattgt

SEQ ID NO: 5518 - DNA, 50 bp, Homo sapiens
aagactagagctacactaggccactatcttattacacgacagcacaacat

SEQ ID NO: 5519 - DNA, 50 bp, Homo sapiens
ttaagaaccccaaagattaaaggaaacaatgttaagggcttttgtgagga

SEQ ID NO: 5520 - DNA, 50 bp, Homo sapiens
cggaagtcgaaatcaaatctatgcttttaattgaaaccgtgcctgaaacg

SEQ ID NO: 5521 - DNA, 50 bp, Homo sapiens
tcttcaccaggttcaagctccgtgggccacactgctgctgtgccaagaag

SEQ ID NO: 5522 - DNA, 50 bp, Homo sapiens
gatacactgtccagcccaggtccaggccctaggttctttactctagctac

SEQ ID NO: 5523 - DNA, 50 bp, Homo sapiens
tggaatttactaaattgtgaaattaacgtaaccgaagcaacaaccggcaa

SEQ ID NO: 5524 - DNA, 50 bp, Homo sapiens
gcgggaggctgggactttccattacaaatagagacttcattcctgttgag

SEQ ID NO: 5525 - DNA, 50 bp, Homo sapiens
actcaggtggtgctggtgttagtgatgctggagaagagaatattactggt

SEQ ID NO: 5526 - DNA, 50 bp, Homo sapiens
caggttgctttcgtgtccctcttctggttgctttagaagtgacgtgtaat

SEQ ID NO: 5527 - DNA, 50 bp, Homo sapiens
aaacacagcccaccccatttcagaccgccttcctgaggagaaaatgacag

SEQ ID NO: 5528 - DNA, 50 bp, Homo sapiens
gctaactggataaagtttgtgcagacattcctgagtgtacgatattgacc

SEQ ID NO: 5529 - DNA, 50 bp, Homo sapiens; identical to SEQ ID NO: 5528

SEQ ID NO: 5530 - DNA, 50 bp, Homo sapiens
agctggcttcactgctcaggtgattatcctgaaccaccaggccaaataag

SEQ ID NO: 5531 - DNA, 50 bp, Homo sapiens
agtcaggactgtctaggtcagggaagccaagatgtctgaagagagaggaa

SEQ ID NO: 5532 - DNA, 50 bp, Homo sapiens
attcaaccagtaatggtacctgaggaattgaaatgggtatttgtttctgt

SEQ ID NO: 5533 - DNA, 50 bp, Homo sapiens
agtggagaggccctgttagtttacttttcatattgagtgatgcatgaggt

SEQ ID NO: 5534 - DNA, 50 bp, Homo sapiens
gcattctatttaaaaagggagtggggagcaaatgaaaattaaatgtgggg

SEQ ID NO: 5535 - DNA, 50 bp, Homo sapiens
tcaccaggaaaacatgcttgtgaattgtgcagtaaaaggtggtaatgact

SEQ ID NO: 5536 - DNA, 50 bp, Homo sapiens
ccttttctctcccatgaccctttaacagcatctgcttcattcccctcacc

SEQ ID NO: 5537 - DNA, 50 bp, Homo sapiens; identical to SEQ ID NO: 1754

SEQ ID NO: 5538 - DNA, 50 bp, Homo sapiens
tgagtgaacaaagctgtgaaacattctgcgtttatgcaacttccttgcct

SEQ ID NO: 5539 - DNA, 50 bp, Homo sapiens
caagaagacaagcatctgtggtgcggaggcaagcaggctaactaggagtt

SEQ ID NO: 5540 - DNA, 50 bp, Homo sapiens
ttggcccagtgtgattgattgctttatctttggtacttttacttgaatgg

SEQ ID NO: 5541 - DNA, 50 bp, Homo sapiens
catccagcactaattttcatgcatttatgaaaggatgcctgaggaccctt

SEQ ID NO: 5542 - DNA, 50 bp, Homo sapiens
agcctgaggcaaataaaattccagtaatttcgaagaatgggtgttggcaa

SEQ ID NO: 5543 - DNA, 50 bp, Homo sapiens
aggaccttgacaagccgtttgagatggaatgtaggccctgatgttatgct

SEQ ID NO: 5544 - DNA, 50 bp, Homo sapiens; identical to SEQ ID NO: 5543

SEQ ID NO: 5545 - DNA, 50 bp, Homo sapiens
agtggagtgtttacaccttgctgtaacatttgaactttcacaagagatgt

SEQ ID NO: 5546 - DNA, 50 bp, Homo sapiens
atatcatattatttgatgccattaggcggcctggatcaccaattctaagt

SEQ ID NO: 5547 - DNA, 50 bp, Homo sapiens
gccaccagacagaaggaccagagtttctgattataaacaatgatgctggg

SEQ ID NO: 5548 - DNA, 50 bp, Homo sapiens
tgttggtgagcaatgtgcagaggcagagccgctgaagtatggttcctgag

SEQ ID NO: 5549 - DNA, 50 bp, Homo sapiens
ggctgctgttgactgaaattcctatcctcaaattactctagactgaagct

SEQ ID NO: 5550 - DNA, 50 bp, Homo sapiens
ctttttagtaggcaaaggttcttcttcctcctcttttggtgcagggacgc

SEQ ID NO: 5551 - DNA, 50 bp, Homo sapiens
gcgtgtatgtgggatgccataggtgtgactgtagagtcattcttccttcc

SEQ ID NO: 5552 - DNA, 50 bp, Homo sapiens
tgtaagttgactttcaaaagtctctggaaacactggactttagctggtcc

SEQ ID NO: 5553 - DNA, 50 bp, Homo sapiens
gaagcgtggcagagaactatggatcaggcagcccctctcatctttaccat

SEQ ID NO: 5554 - DNA, 50 bp, Homo sapiens
ttggtccaaactctggagccttgtgggagaacatagggcataacgtgttt

SEQ ID NO: 5555 - DNA, 50 bp, Homo sapiens
cccttcttagtaaagagacatcttctacagtaaccacagagaagaagtgg

SEQ ID NO: 5556 - DNA, 50 bp, Homo sapiens
tggacataacctgggtcagaagagaaacttttgaagctacacgaacaagc

SEQ ID NO: 5557 - DNA, 50 bp, Homo sapiens
cggctcaaataaacctttaccggatttttggggttatgcccacacccttg

SEQ ID NO: 5558 - DNA, 50 bp, Homo sapiens
ggaccactagtactccagaaccataatataactagacatgcctggaatgc

SEQ ID NO: 5559 - DNA, 50 bp, Homo sapiens
aacaagccatgtttgccctagtccaggattgcctcacttgagacttgcta

SEQ ID NO: 5560 - DNA, 50 bp, Homo sapiens; identical to SEQ ID NO: 4387

SEQ ID NO: 5561 - DNA, 50 bp, Homo sapiens
gagaaacttccgtgcatgaaggtttcctccttgactcggcagcagcggcc

SEQ ID NO: 5562 - DNA, 50 bp, Homo sapiens
ccaagtaggttttaactctggtatggtctcgtgttttcatttgttgtgca

SEQ ID NO: 5563 - DNA, 50 bp, Homo sapiens
gttcccacggagctgacttctccggggtgcctgtgccctacattaaaccc

SEQ ID NO: 5564 - DNA, 50 bp, Homo sapiens
ccgtaactccgacaaacgcagaacttcttgaggctttcttcttctaagga

SEQ ID NO: 5565 - DNA, 50 bp, Homo sapiens
tctggaccctgcttgggttcacagcattggtggaggtaagtagtattctc

SEQ ID NO: 5566 - DNA, 50 bp, Homo sapiens
gaagaggaagctcatccgaagtcttccgacagagtgagccgtcatgcccg

SEQ ID NO: 5567 - DNA, 50 bp, Homo sapiens
agtgtgtattcttgatgtttattggctcatgtggacagaaatgtacaggg

SEQ ID NO: 5568 - DNA, 50 bp, Homo sapiens
agatgaggctgctctgaagattcagtaattaggatggacagtcagctact

SEQ ID NO: 5569 - DNA, 50 bp, Homo sapiens
tgggctttggggttcagtttgttacctttggagacttatttaatgaaacc

SEQ ID NO: 5570 - DNA, 50 bp, Homo sapiens
cagtggttcctgagagaatcttagttcaaaggactgcccccgccaacccc

SEQ ID NO: 5571 - DNA, 50 bp, Homo sapiens
accgccaaagccaatcatccactttcagtacttacctaaccaatctccca

SEQ ID NO: 5572 - DNA, 50 bp, Homo sapiens
caggatgttattgacagggtggcctttgtgattcctccggtggtggcagc

SEQ ID NO: 5573 - DNA, 50 bp, Homo sapiens
gccatttcatttgctgtgtggttagacttccaggaggctgtttagctcta

SEQ ID NO: 5574 - DNA, 50 bp, Homo sapiens
cctttgtgaaaagtcacctgtgactgtcaggggtatgctatgggcctttt

SEQ ID NO: 5575 - DNA, 50 bp, Homo sapiens
gatccactttggggttcggcggcagattattccgctggtagagccggatg

SEQ ID NO: 5576 - DNA, 50 bp, Homo sapiens
aataagggactcattcattatgcagcaaatgttgtttgttattggcttgc

SEQ ID NO: 5577 - DNA, 50 bp, Homo sapiens
cttcatggtctccagccaggactccatcagcgccacggcttcatccgaac

SEQ ID NO: 5578 - DNA, 50 bp, Homo sapiens
ttgatgctcatcatctgctcgaggtgattgatgccaggttgacgcaccat

SEQ ID NO: 5579 - DNA, 50 bp, Homo sapiens
tcctttggataaggtccaaaacctgtaacacatgaccctcagagcccttt

SEQ ID NO: 5580 - DNA, 50 bp, Homo sapiens
cccggcgacttcaccacccgctatctgggcaccaaagactatatctagat

SEQ ID NO: 5581 - DNA, 50 bp, Homo sapiens
cgcaatagtcctcgacaagtcgccaaccctcccacttcggtcgatcagct

SEQ ID NO: 5582 - DNA, 50 bp, Homo sapiens
cgtcgggtacctcgccgataaaatcgctgatggcctggtcgatcctgaag

SEQ ID NO: 5583 - DNA, 50 bp, Homo sapiens
atcttatccctctgttactcaatgtgagtgcatactttacattgcctact

SEQ ID NO: 5584 - DNA, 50 bp, Homo sapiens
ggtccttgaagatgacgcggatgatcgaggtctctgcgccgtaggcgatg

SEQ ID NO: 5585 - DNA, 50 bp, Homo sapiens
atgatgaagctgctgtccaacgccttcgtctgccagtttctgctggtgtg

SEQ ID NO: 5586 - DNA, 50 bp, Homo sapiens
tccttgccagagccttcgggttctacgatttgatcgacgacgctggtgtc

SEQ ID NO: 5587 - DNA, 50 bp, Homo sapiens
tcgaacatgggcagctccgtttcaagatggctcaagactagcggattggg

SEQ ID NO: 5588 - DNA, 50 bp, Homo sapiens
agtgatagagaccaaagactgctttttaattttgtgggggagggggtgga

SEQ ID NO: 5589 - DNA, 50 bp, Homo sapiens
cgggtcactcatgttggctactaacccttttcgtgcgccgggcattctag

SEQ ID NO: 5590 - DNA, 50 bp, Homo sapiens
cttgtccttgatcgcttccttctctgcaagggagagcttctggaccttca

SEQ ID NO: 5591 - DNA, 50 bp, Homo sapiens
cttgtttgacatcagcgccatctcgacagcgtattccgctatgactgttt

SEQ ID NO: 5592 - DNA, 50 bp, Homo sapiens
cacgaagccttcgatcagttgcagcacgcggccagagcggtcgatagaac

SEQ ID NO: 5593 - DNA, 50 bp, Homo sapiens
cattttgccatctgcgagcatctgggtattgacatgatccccagtggagc

SEQ ID NO: 5594 - DNA, 50 bp, Homo sapiens
caccaagctggtcaacatccaggcgaatggctattacgtggatgagatca

SEQ ID NO: 5595 - DNA, 50 bp, Homo sapiens
ttgctgatacggcctttgatcatgttttcaacgatgttttccggcttgcc

SEQ ID NO: 5596 - DNA, 51 bp, Homo sapiens
cctcgacaaactaaatgttgatttgaattggcctgttatcatcttgatcac

SEQ ID NO: 5597 - DNA, 50 bp, Homo sapiens
gtttcagatcgggccgctcccgccgggtacctatagcggaatcgaatttc

SEQ ID NO: 5598 - DNA, 50 bp, Homo sapiens
gaaaacagaaatgatgctcggcacattctcgtccagcacctcggcaacgg

SEQ ID NO: 5599 - DNA, 50 bp, Homo sapiens
aactgtattcgatcaccgtggcgctgatggtgtcagcagtcgccttgttc

SEQ ID NO: 5600 - DNA, 51 bp, Homo sapiens
agttgacatataacccactttacatacattccaaaattgcgagtagtgagt

SEQ ID NO: 5601 - DNA, 50 bp, Homo sapiens
atatcgtaccgagaaactagtgcggatatctgaccaggtatggcggttgg

SEQ ID NO: 5602 - DNA, 50 bp, Homo sapiens
gtggatgacctgatccaggtcggcctgatcggcctgactgatgagctgtc

SEQ ID NO: 5603 - DNA, 50 bp, Homo sapiens
atgatgaccagatgctctggcaccgtgtcgagttcgaggatgccgacatt

SEQ ID NO: 5604 - DNA, 50 bp, Homo sapiens
gatctgggacgcatggccgaagctgaaaagctggctgtagaagacctcga

SEQ ID NO: 5605 - DNA, 50 bp, Homo sapiens
aacatggcaatatttattggtcctaatactgtcactggcaaggttggtgt

SEQ ID NO: 5606 - DNA, 50 bp, Homo sapiens
gaggcagaggtgtagcgagtccaggctctcttcgaacgttgcacccgacg

SEQ ID NO: 5607 - DNA, 50 bp, Homo sapiens
gtcccacacgttcggccctgactctgctgtgttcgacgaggacaatctcg

SEQ ID NO: 5608 - DNA, 50 bp, Homo sapiens
catgacgttgtgctcgacaccccaacagatcacgtaatcagcctggtgga

SEQ ID NO: 5609 - DNA, 51 bp, Homo sapiens
taggctatagagatgtgagggattattattagtcacacctctagtcatgcc

SEQ ID NO: 5610 - DNA, 50 bp, Homo sapiens
ggctgccggatgtgtaggtcttcccatgttgtgaagtaacggtgctccac

SEQ ID NO: 5611 - DNA, 50 bp, Homo sapiens
tgccctgtatagtgttgtaaaaattagaatgtttcacccaaaccatctgg

SEQ ID NO: 5612 - DNA, 50 bp, Homo sapiens
gtctttcgaatcgctctttagctcgtgcgggctgttgtcccacttgttgg

SEQ ID NO: 5613 - DNA, 50 bp, Homo sapiens
ctatgcgctgcgctacaagctggacctgtattcggacttcagctactacc

SEQ ID NO: 5614 - DNA, 50 bp, Homo sapiens
ttcgaagcgacgctgcgtgcgctgctcgtccaattgcagcatggataagg

SEQ ID NO: 5615 - DNA, 50 bp, Homo sapiens
ccttccgctgtcccttcagtagctgtttctgttccctgacgcccacttct

SEQ ID NO: 5616 - DNA, 50 bp, Homo sapiens
caatgcagcggctgatgcagatcacccacgagatgcaggacgaaggcgag

SEQ ID NO: 5617 - DNA, 50 bp, Homo sapiens
tcattcagtctgagtaggaggaaagaggacaggttgttggagagttggtt

SEQ ID NO: 5618 - DNA, 50 bp, Homo sapiens
taattgccgctgaagcacgaatcctcgaaatgcgtcaccttcggattgac

SEQ ID NO: 5619 - DNA, 50 bp, Homo sapiens
aaatgtggtgacaaagtaccagcaagaactggactgtgtttctggagcct

SEQ ID NO: 5620 - DNA, 50 bp, Homo sapiens
gttcatcgtctcgcgtcgcaagaagtaagggctaggccatgactcgttcg

SEQ ID NO: 5621 - DNA, 50 bp, Homo sapiens
ctcttggcagccctgctctcgtgggtcagcatcgtcgcgtgctccggtgg

SEQ ID NO: 5622 - DNA, 50 bp, Homo sapiens
gtgctcgctgagctggtccagaaatccgtcgactgaggcgatggcggctg

SEQ ID NO: 5623 - DNA, 50 bp, Homo sapiens
catgaacaagggccggatcatcctgatgcccaacacactggacttcggtg

SEQ ID NO: 5624 - DNA, 50 bp, Homo sapiens
cacccgttgtaggcgacgagcgtgaacgaaaacgtgtcggacggcttgta

SEQ ID NO: 5625 - DNA, 50 bp, Homo sapiens
catatgcggctgtgccatagccggatgttcttcgtgcgtgcctacccccg

SEQ ID NO: 5626 - DNA, 50 bp, Homo sapiens
ttctttccgtcgcgcatcggaatgcgaaactcgtacttcgtgtagaactc

SEQ ID NO: 5627 - DNA, 50 bp, Homo sapiens
gccaggggctttatcacttccatggccgcagcgatgaccaggtcaagctg

SEQ ID NO: 5628 - DNA, 50 bp, Homo sapiens
cgccgaccaagcttaccgacttctcgccgatctactgcgacgaagaaggc

SEQ ID NO: 5629 - DNA, 50 bp, Homo sapiens
ggtagtgacgtgctgaatgacggtgccgtccatcatcgggtcggagtaag

SEQ ID NO: 5630 - DNA, 50 bp, Homo sapiens
ttcaggactcgtttcacgtaggcaacgctgtctaaagttcccaagggatt

SEQ ID NO: 5631 - DNA, 50 bp, Homo sapiens
ctctttacccggaaacaggttggggagatgacacgcagaaaatcatacgc

SEQ ID NO: 5632 - DNA, 50 bp, Homo sapiens
ctttggatatatcgagaaaggccagggcctgaacaaggaaagcttccagg

SEQ ID NO: 5633 - DNA, 50 bp, Homo sapiens
aaggctggtcaagaatcttgagacggaattgcacagtctcggcgtgatcc

SEQ ID NO: 5634 - DNA, 50 bp, Homo sapiens
gatcgattcgggggtgacatcggcgctgagcaccatcaccggaacataag

SEQ ID NO: 5635 - DNA, 50 bp, Homo sapiens
ctgagatcaccctgaacaccgacaaggacgagatcgcagtctgcaacctg

SEQ ID NO: 5636 - DNA, 50 bp, Homo sapiens
ctgaaggctttggcgacaaccaggtctatccgtttgaaattggcgagaac

SEQ ID NO: 5637 - DNA, 50 bp, Homo sapiens
tcttgtgccagcacgtcttgctgatagccgatgaatcgcgtccctttgtc

SEQ ID NO: 5638 - DNA, 50 bp, Homo sapiens
gaactcctcaaggaaatagtccaccgcctgctgcttggacgctgccagtt

SEQ ID NO: 5639 - DNA, 50 bp, Homo sapiens
gtgacctcggggtcccccttggtgagggtgccggtcttgtcgaagacgac

SEQ ID NO: 5640 - DNA, 50 bp, Homo sapiens
gtgttcgggcttcatgtcgccaacaccatcggcactggcatcatcgatcc

SEQ ID NO: 5641 - DNA, 50 bp, Homo sapiens
aggttgatttccacttcctcgggaggtttcgccacctcttcgcctttgag

SEQ ID NO: 5642 - DNA, 50 bp, Homo sapiens
gttagcttccacgctttatctcctgctctgagtgtgtacccgcgctgctc

SEQ ID NO: 5643 - DNA, 50 bp, Homo sapiens
ttaaagtggtaagggaggtttctactcctggggaaacattaaagtacctt

SEQ ID NO: 5644 - DNA, 50 bp, Homo sapiens
ctttctccgacttcgagatctgcccgtggtcgagatcgtggtagatgatg

SEQ ID NO: 5645 - DNA, 50 bp, Homo sapiens
aactggatagagcacgagccttctaagcttggagttgcaggttcgaatcc

SEQ ID NO: 5646 - DNA, 50 bp, Homo sapiens
gaagatcggcgcaacgaagaccgcttccacttcatcaactggaccaagaa

SEQ ID NO: 5647 - DNA, 50 bp, Homo sapiens
tgcttctgtgacagattagcttacatcttaccacctcaccgagaagagct

SEQ ID NO: 5648 - DNA, 50 bp, Homo sapiens
agctcaagagcttccgcgacgtacccagcaaagtaacgctcgacgaatgc

SEQ ID NO: 5649 - DNA, 50 bp, Homo sapiens
atcgaagacgtgatgctgaacctttgggcgaaggccgagaaggaaggcaa

SEQ ID NO: 5650 - DNA, 50 bp, Homo sapiens
cgataccctcactagacctcggatcgaaataaatcagagcgatcacatcg

SEQ ID NO: 5651 - DNA, 50 bp, Homo sapiens
ggggatacacaccccacaagccttcctgcggcttcatcacggttaccacc

SEQ ID NO: 5652 - DNA, 50 bp, Homo sapiens
gatcttggtgagaagctcggtcatgtagaagacctcgccctgggacacta

SEQ ID NO: 5653 - DNA, 50 bp, Homo sapiens
attttatcgccagctacgtcggcattggtcaggacgacctgaaggggaat

SEQ ID NO: 5654 - DNA, 50 bp, Homo sapiens
tgatgcggagagcgaggtagatcccggcggagttttcgtcgatgggaaag

SEQ ID NO: 5655 - DNA, 50 bp, Homo sapiens
gtacacttcctggatctgatccacgaggtaacgagcgagagtggtgatac

SEQ ID NO: 5656 - DNA, 50 bp, Homo sapiens
gtgacttcatgctcggggttgagcttggcgtccaccaccttttcccactc

SEQ ID NO: 5657 - DNA, 50 bp, Homo sapiens
ccggtgtccttgatcagcttcagcagtggcttgacgtagatgcgggtcgg

SEQ ID NO: 5658 - DNA, 50 bp, Homo sapiens
catcagtgtttctcctgctgggactgttgcatgtggtgcatcacggtttg

SEQ ID NO: 5659 - DNA, 50 bp, Homo sapiens
gcgaggcgaaacatagcttccattgtgtcttttctccttatgcgtcttgc

SEQ ID NO: 5660 - DNA, 50 bp, Homo sapiens
aatgagacccgccgtccctggagatgaagatgtcgtccgactccgtccac

SEQ ID NO: 5661 - DNA, 50 bp, Homo sapiens
cggatgttgtcgttccagaacgaaggatcggcctcttgggcctggatttc

SEQ ID NO: 5662 - DNA, 50 bp, Homo sapiens
ggcaccgacttgggcctgagagaggcgcaggtcatcaatatagaatcggg

SEQ ID NO: 5663 - DNA, 50 bp, Homo sapiens
ccatgctgaacttggccaggtccttgacggcggtgttttccgacagcacc

SEQ ID NO: 5664 - DNA, 50 bp, Homo sapiens
cgcgatgatctcgtccttcggcatggcgatgcgctattccttcgacatgg

SEQ ID NO: 5665 - DNA, 50 bp, Homo sapiens
gcccattgaccgtatcgcgtcatcttgctggcatttctaagaaaataccg

SEQ ID NO: 5666 - DNA, 50 bp, Homo sapiens
tgaaacagggaaaagccaggaagatctccggttccacgtccaatttgtac

SEQ ID NO: 5667 - DNA, 50 bp, Homo sapiens
caagaatgacggaaaaatccgtgagcacaaggcaaaggcttgccgtgtgg

SEQ ID NO: 5668 - DNA, 50 bp, Homo sapiens
gacttgatcacaacccgatccgtaacgacgtattggagccactcgaacaa

SEQ ID NO: 5669 - DNA, 50 bp, Homo sapiens
cttctcgccgtaacttttccgccgagcacgctacgcacgtaggtgttgtg

SEQ ID NO: 5670 - DNA, 50 bp, Homo sapiens
tcgactacgacttcaacttccccaaacggtgggagaagcgagcttgaggc

SEQ ID NO: 5671 - DNA, 50 bp, Homo sapiens
aagttgatcagatcacgggccacgcctgcaaccagaggcttgtcatcgtc

SEQ ID NO: 5672 - DNA, 50 bp, Homo sapiens
tgatctgattgtgaggagagtggagaaggtggtatagaagctgaaagggt

SEQ ID NO: 5673 - DNA, 50 bp, Homo sapiens
cttcatgctcgagaagaaaatgctccgtgcctccgacgacgccaccatcg

SEQ ID NO: 5674 - DNA, 50 bp, Homo sapiens
cagatggtcacgagacgcttgtccgtgatgtcttccgtcagcgtgcagag

SEQ ID NO: 5675 - DNA, 50 bp, Homo sapiens
tgatggatttggaaagtgttattctgtttgacttctccctgctctgctca

SEQ ID NO: 5676 - DNA, 50 bp, Homo sapiens
ttgaacgggtatagccaccaaggcattggctgcaaagtcgggcaaaactt

SEQ ID NO: 5677 - DNA, 50 bp, Homo sapiens
actgtgtattgatgagtatctgatgcctataacatctgtaggaggctaca

SEQ ID NO: 5678 - DNA, 50 bp, Homo sapiens
gtacgaaggtggcgatgatgcgttcgatcacctcggggatttcctcggcg

SEQ ID NO: 5679 - DNA, 50 bp, Homo sapiens
cgaccttcggcgtttccgcttcggaacccgtgaaggcgttcttcactttg

SEQ ID NO: 5680 - DNA, 50 bp, Homo sapiens
attcgctggcaacataattaccagactcacatcgaacgaagctcggttcc

SEQ ID NO: 5681 - DNA, 50 bp, Homo sapiens
tgttcgttgccatccttgtcgaggaacatctcgctttccagttccgcctg

SEQ ID NO: 5682 - DNA, 50 bp, Homo sapiens
tttgggggatccttttgtaatgacttacactggaaatgcgaacatttgca

SEQ ID NO: 5683 - DNA, 50 bp, Homo sapiens
ggacaaggggcacccggattatatttcccaccaatcctaatcctaaaccc

SEQ ID NO: 5684 - DNA, 50 bp, Homo sapiens
tggagcttattttggagaactgtcaccattttatcccagttggcaatttt

SEQ ID NO: 5685 - DNA, 50 bp, Homo sapiens
attatgggtaaggcttgggcttgttcccacatgttaaccaaatggcctca

SEQ ID NO: 5686 - DNA, 50 bp, Homo sapiens
gggagggccaaagaaatctttttcccgtttcaaattatgttccccaaaaa

SEQ ID NO: 5687 - DNA, 50 bp, Homo sapiens
ttaccccaatgcttttgccccggtggcccagtttgtaaattggtttgatt

SEQ ID NO: 5688 - DNA, 50 bp, Homo sapiens
ccccccttggcaggttaattggtgtttaaggaaccctccagggtgggggg

SEQ ID NO: 5689 - DNA, 51 bp, Homo sapiens
ccccccagttttaatgttagggggaagggatttaaccccttatttaaaaaa

SEQ ID NO: 5690 - DNA, 50 bp, Homo sapiens
ctatcacccttgatatgaaattccagaattttctgtgataccacatggcc

SEQ ID NO: 5691 - DNA, 50 bp, Homo sapiens
actccgggccttaatggatttggcctgtcctcaagaatggtaattatgaa

SEQ ID NO: 5692 - DNA, 50 bp, Homo sapiens
acgtggtttcagtccttagcaccgtggtattgacatgacatcagttgcaa

SEQ ID NO: 5693 - DNA, 50 bp, Homo sapiens
cacaacttgctgttcacgtctttggggtgttttccattcctaatagatgg

SEQ ID NO: 5694 - DNA, 50 bp, Homo sapiens
aaacccgtcctccattataattacctttcaaagggcaagtcaaaagttgt

SEQ ID NO: 5695 - DNA, 50 bp, Homo sapiens
aaacagcacaacatgagtgtttcctaccacatcaattttaatgaagacac

SEQ ID NO: 5696 - DNA, 50 bp, Homo sapiens
cggaatcgggtttccattggaccccaaaaatttccctttgggcttcatga

SEQ ID NO: 5697 - DNA, 50 bp, Homo sapiens
tgaggatagaagcagccttttatatttttgtgtggtaaagcaaattggca

SEQ ID NO: 5698 - DNA, 50 bp, Homo sapiens
ggggcaaatttcaagggacctccccaaagggggtgttttccctggatggg

SEQ ID NO: 5699 - DNA, 51 bp, Homo sapiens
aaacaggaagggggtttgggccctttgatcaactggaacctttggatcaag

SEQ ID NO: 5700 - DNA, 50 bp, Homo sapiens
actctttgtctttttaagacccctaatagccctttgtaacttgatggctt

SEQ ID NO: 5701 - DNA, 50 bp, Homo sapiens
ccggctgcctccatcccagaagagtgcgcagagaattaaatctagatatt

SEQ ID NO: 5702 - DNA, 50 bp, Homo sapiens
gggatgtaatacatatttttccaaataaaatgcctcatgggctttggggc

SEQ ID NO: 5703 - DNA, 50 bp, Homo sapiens; identical to SEQ ID NO: 4309

SEQ ID NO: 5704 - DNA, 50 bp, Homo sapiens
agttagtatacagccagaacagccaagcctcaattcttgtaccttgtgtc

SEQ ID NO: 5705 - DNA, 50 bp, Homo sapiens
ccctgatcctctgtagggaacttccttttctctaatcctagatcttttca

SEQ ID NO: 5706 - DNA, 50 bp, Homo sapiens
gaggcatcagaggttcaggagagttacaggcagcaggtgcggtataatat

SEQ ID NO: 5707 - DNA, 50 bp, Homo sapiens
tttgtttctttgggcctgatttgtatctctggaaggcattaattcttgaa

SEQ ID NO: 5708 - DNA, 50 bp, Homo sapiens
gctttgcctctcggaggagtcaaaggggcagtaactgtatggggtgagag

SEQ ID NO: 5709 - DNA, 50 bp, Homo sapiens
gctcccgaatattgtaatttgttgccccctatgtacccaaccccctgaaa

SEQ ID NO: 5710 - DNA, 50 bp, Homo sapiens
aggaagtatgagagttctgaaacccttgatagaaactggaagcctgccat

SEQ ID NO: 5711 - DNA, 50 bp, Homo sapiens
gacatagggttgcagtagtgagtgggcatctgttctcagaaggcagtgcc

SEQ ID NO: 5712 - DNA, 50 bp, Homo sapiens
ttctggccttgttcacctagaaacgctatttcctgtgttatggttctggc

SEQ ID NO: 5713 - DNA, 50 bp, Homo sapiens
gctctgggaaagagacagggaagtctggaatggaaaagaacacgatgaga

SEQ ID NO: 5714 - DNA, 50 bp, Homo sapiens
gggttacatttgagtctctgtacctgcttggaagaaataaaaatacgtgt

SEQ ID NO: 5715 - DNA, 50 bp, Homo sapiens
ctgggaatatgaagcgaacgccacacactagaacgcgccctgggagctgg

SEQ ID NO: 5716 - DNA, 50 bp, Homo sapiens
gctgcttttgcccatccaggtttccacatcctaatctttgcttttcttgt

SEQ ID NO: 5717 - DNA, 50 bp, Homo sapiens
tgtaaatgtggtttgactatttctgtatgtccccatctattgatgagggt

SEQ ID NO: 5718 - DNA, 51 bp, Homo sapiens; identical to SEQ ID NO: 5427

SEQ ID NO: 5719 - DNA, 50 bp, Homo sapiens
acataaactgtccctttaggaagaagcccaatgcccgattttgcccttta

SEQ ID NO: 5720 - DNA, 50 bp, Homo sapiens
ggacaagtggcatcggtactatatttcccaccaatcctaatcctaatccc

SEQ ID NO: 5721 - DNA, 50 bp, Homo sapiens
tatgtccctttttctcctcccttccccattccctggcatcatattgggac

SEQ ID NO: 5722 - DNA, 50 bp, Homo sapiens; identical to SEQ ID NO: 4876

SEQ ID NO: 5723 - DNA, 50 bp, Homo sapiens
tgtgggcttggtataaaccctactttgtgatttgctaaagcacaggatgt

SEQ ID NO: 5724 - DNA, 50 bp, Homo sapiens
ccgcctgaaacgggcattttgtaaatggggtttgactatttttgtatgtc

SEQ ID NO: 5725 - DNA, 50 bp, Homo sapiens
actggcaaatgaagcatactggcttgcagggaccttctgattcaagtaca

SEQ ID NO: 5726 - DNA, 50 bp, Homo sapiens
gaattcgatttgagatctgagggcagacccgaaccaggaaagcaactcag

SEQ ID NO: 5727 - DNA, 50 bp, Homo sapiens
aatgcaccaggctgccacctgcaccagtggttgctacatgggataagaaa

SEQ ID NO: 5728 - DNA, 50 bp, Homo sapiens
tatgataggattctccacagtggcttccgactcaggctccaatggaccaa

SEQ ID NO: 5729 - DNA, 50 bp, Homo sapiens
tgctgtatgggcaggttgtcttattatgtgatcaacagatgtccaggaac

SEQ ID NO: 5730 - DNA, 50 bp, Homo sapiens
acctccaagaacatctgcctttgttgaacgtgtttattacctgtccactc

SEQ ID NO: 5731 - DNA, 50 bp, Homo sapiens
ccttttgccccttagcccttggataatccggctgggaatgggggtgaggg

SEQ ID NO: 5732 - DNA, 50 bp, Homo sapiens
cccaaataagctctgtacttcggttacctatgtacctgttaccactttca

SEQ ID NO: 5733 - DNA, 50 bp, Homo sapiens
gccacatgtcctattctcacacaggtgctttaatttcagcccagtctcta

SEQ ID NO: 5734 - DNA, 50 bp, Homo sapiens
cttgaaggggctttgttgggtttttggggttttgggtgggactcccaaag

SEQ ID NO: 5735 - DNA, 52 bp, Homo sapiens
ggggttttaaaaattttcccgatttcaaaattaattttccgttgccccccgg

SEQ ID NO: 5736 - DNA, 50 bp, Homo sapiens
ccccctggggtttttgggaatgaggtaaggctttgaatttggtttgatat

SEQ ID NO: 5737 - DNA, 50 bp, Homo sapiens
acatgcttagagctggaggcttgaaaccataatcccaattaagtgctgtc

SEQ ID NO: 5738 - DNA, 50 bp, Homo sapiens
tgtttgtccaggaaaaggaagagggggaaattaaaacctttccggttagt

SEQ ID NO: 5739 - DNA, 50 bp, Homo sapiens
gcactgctccgtctagctgtatgacctttgttatgtttcttttcttccgt

SEQ ID NO: 5740 - DNA, 50 bp, Homo sapiens
cttcaatctgggctgggcactccacgcacataatcgtcactctcggagga

SEQ ID NO: 5741 - DNA, 50 bp, Homo sapiens
gcgggaagtgaaagcggaggctgggacaaggggaacttactgctcaaaaa

SEQ ID NO: 5742 - DNA, 50 bp, Homo sapiens
agtggtgtggtggcaataggaaaagaaaagatcaggatgagaaattgctt

SEQ ID NO: 5743 - DNA, 50 bp, Homo sapiens
ccaagggccttttggggttgtttcctataacttcagtattgtaaattagt

SEQ ID NO: 5744 - DNA, 50 bp, Homo sapiens
cataaaggggcattgccctagccggtccggcctttttccagtccatcctg

SEQ ID NO: 5745 - DNA, 51 bp, Homo sapiens
aggtttaagaaatttcccctaaatcttgtttggttggttgggatgaaaagt

SEQ ID NO: 5746 - DNA, 50 bp, Homo sapiens
aattgatcccattcttgctgaagtagacagtgccctcaagtggaattaaa

SEQ ID NO: 5747 - DNA, 50 bp, Homo sapiens
ctccaatgctgttatcccggctgggtcctcacactcccccaacaatccca

SEQ ID NO: 5748 - DNA, 50 bp, Homo sapiens
agaatgcgctatttccctcaaagccctggctgtaataaagaagccgattt

SEQ ID NO: 5749 - DNA, 50 bp, Homo sapiens
ctgaggtcagtgtggtttggtggaaggattatgatatttacaagctgagt

SEQ ID NO: 5750 - DNA, 50 bp, Homo sapiens
ggtcaatgttttgaaatttgtggagcaaaccccagttttatgcccttggt

SEQ ID NO: 5751 - DNA, 50 bp, Homo sapiens
agttggaaaatttagaaatgtccactgtaggacgtggaatatggcgtcga

SEQ ID NO: 5752 - DNA, 50 bp, Homo sapiens
ttcacgtcctaaagtgtggtagacgcgcccgcgaatttagtagtagtagg

SEQ ID NO: 5753 - DNA, 50 bp, Homo sapiens
ggacaagtggcatccgtattatatttcccaccattcctattcttaatccc

SEQ ID NO: 5754 - DNA, 50 bp, Homo sapiens
ggtctgcctcagtcttctactcatcagcaccacactgtcaaaatgttgga

SEQ ID NO: 5755 - DNA, 50 bp, Homo sapiens
agatgaattgaagcaaaaagttttcagtaccagcagcaaggcagaccccc

SEQ ID NO: 5756 - DNA, 50 bp, Homo sapiens
tcacctccacctctgagggagcaacgaatacaaaggtagacccccaaaag

SEQ ID NO: 5757 - DNA, 50 bp, Homo sapiens
ccccagccagcacttcccttttctgcgagggttttctgtttctttgatta

SEQ ID NO: 5758 - DNA, 50 bp, Homo sapiens
agaaaatttgaaccctacgcttctcccatcccacttcttactccatcccg

SEQ ID NO: 5759 - DNA, 50 bp, Homo sapiens
ctgtggcatcattcacaccaccagcagagtcccttccaagaggggtctgg

SEQ ID NO: 5760 - DNA, 50 bp, Homo sapiens
ccgtgttaaaaccaaagtttgggatttttcgggtattcattggaagtcac

SEQ ID NO: 5761 - DNA, 50 bp, Homo sapiens
cgagagcctggaagctttgcacactactgcctggaagatctgattctttg

SEQ ID NO: 5762 - DNA, 50 bp, Homo sapiens
tgttttaaaagtgggtttatttcaaccccttcactcccggttggtgaccg

SEQ ID NO: 5763 - DNA, 50 bp, Homo sapiens
tcttctctcagtcttcagcaagtagcttctttcagaactgcctcctcccg

SEQ ID NO: 5764 - DNA, 50 bp, Homo sapiens
gttttctgcatcccaaatgtcctggggcatgtgtcccttccttgctgacc

SEQ ID NO: 5765 - DNA, 50 bp, Homo sapiens
tgttatgattctctcaatttcataaagctcttctggcagaggagacagat

SEQ ID NO: 5766 - DNA, 50 bp, Homo sapiens
aaatggattacaatttccctgacatttgggcataaaacatctgccatcct

SEQ ID NO: 5767 - DNA, 50 bp, Homo sapiens
tcctccttccagagacctttgctttactgccattttttctgtgggctttt

SEQ ID NO: 5768 - DNA, 50 bp, Homo sapiens
aggcatagcagtagaatctgtcaaaaaggaggcatggaatgaaatgaacc

SEQ ID NO: 5769 - DNA, 50 bp, Homo sapiens
ctgaccctctcgcccctccacctgtgcttctgccctaggataacgctggg

SEQ ID NO: 5770 - DNA, 50 bp, Homo sapiens
gacccaaagaaaagatcaagaccgcatgtagcaaatgtagcaaggaggca

SEQ ID NO: 5771 - DNA, 50 bp, Homo sapiens
ctaatttcccactaaaaggtccagaaaaattgatgccacctgtagtttgg

SEQ ID NO: 5772 - DNA, 50 bp, Homo sapiens
gtaaagttccaagcgagtggaaggtaaatcacgactgtggcaccggagcc

SEQ ID NO: 5773 - DNA, 50 bp, Homo sapiens
gaaactgaatgaccatggaatgctgaaattccaaaagaaaaacgtcgcgc

SEQ ID NO: 5774 - DNA, 50 bp, Homo sapiens
tctctcaggtcgtcttcagagtccattccctttgtcttgatcttttctct

SEQ ID NO: 5775 - DNA, 50 bp, Homo sapiens
ctcccatcattccctcccgaaagccattttgttcagttgctcatccacgc

SEQ ID NO: 5776 - DNA, 50 bp, Homo sapiens
gccctgccccctacccttgccctttaaatttttgggactgaataaagaat

SEQ ID NO: 5777 - DNA, 50 bp, Homo sapiens
tgcaggataacttgctcatgaaaggaaatgccagattaaaccccttgcca

SEQ ID NO: 5778 - DNA, 50 bp, Homo sapiens
gccttcccttcgttcctttccaggcaataatgacatcattagtgatgcaa

SEQ ID NO: 5779 - DNA, 50 bp, Homo sapiens
cgccacggctccaatccctatatgagtgagcagtagaatcacataggaat

SEQ ID NO: 5780 - DNA, 50 bp, Homo sapiens
cctagaatcagactttaagcacaagcagggagggaaagcacttgagcagt

SEQ ID NO: 5781 - DNA, 50 bp, Homo sapiens
gcacatgcaaaaactcagatgtgcaaataactgttccctattaactacaa

SEQ ID NO: 5782 - DNA, 50 bp, Homo sapiens
ggtgctcaaactgtattttctccctccctccctccttctttctttccaga

SEQ ID NO: 5783 - DNA, 50 bp, Homo sapiens
ttcttccacgggatttctaattcattaaataggacctccacaccagacct

SEQ ID NO: 5784 - DNA, 50 bp, Homo sapiens
tatccagcctgacttcttcatgctgtactagccttccaatccttaactaa

SEQ ID NO: 5785 - DNA, 50 bp, Homo sapiens
tggacattgggggtcaaacccttttgtttaaattttccctttcccagggc

SEQ ID NO: 5786 - DNA, 50 bp, Homo sapiens
gctgtgccacggtcaggtggcttccaatctgtactcaattgttactgtac

SEQ ID NO: 5787 - DNA, 50 bp, Homo sapiens
tcagagatgctgatgtcatataagtagtttccctgtctggccttggatgt

SEQ ID NO: 5788 - DNA, 50 bp, Homo sapiens
gtatgactgatgatagctgcgaatgaggaggagggaagggaaggctggag

SEQ ID NO: 5789 - DNA, 50 bp, Homo sapiens
ccattgccccggtgttttggtttaattttcccaggcttattttaaaggcc

SEQ ID NO: 5790 - DNA, 50 bp, Homo sapiens
aggaaattaaacatgagcatgacatgaccccaactctcaagaaatcccca

SEQ ID NO: 5791 - DNA, 50 bp, Homo sapiens
atcaggtcccctacaaaattagctactttggcctttcctacaaaattagc

SEQ ID NO: 5792 - DNA, 50 bp, Homo sapiens
tcattcgtttgctttctctgactgacaggcagtaatgacttcaataagct

SEQ ID NO: 5793 - DNA, 50 bp, Homo sapiens
agggcctgcttcagagtttgtttcctaaataaaacaatggctctccccgt

SEQ ID NO: 5794 - DNA, 50 bp, Homo sapiens
cccccaacttacatggaaaagggatggttgcatttctgtgtcatatgcat

SEQ ID NO: 5795 - DNA, 50 bp, Homo sapiens
gcagagggaagaggaaatgctttgaagccttgctagttatttaattagtt

SEQ ID NO: 5796 - DNA, 50 bp, Homo sapiens
gacatagttgcaaaacacaatacttaatactttttctggaggagggggcc

SEQ ID NO: 5797 - DNA, 50 bp, Homo sapiens
accccttttcttaatttctcaggaaaatggcagctccttcttttgtcgtc

SEQ ID NO: 5798 - DNA, 50 bp, Homo sapiens
cctccggtgtcttcggaagcactgaagggacatctggggaccctcacctg

SEQ ID NO: 5799 - DNA, 50 bp, Homo sapiens
actctttgaccaataaatcactggaatagaggttccagcatattctgaga

SEQ ID NO: 5800 - DNA, 50 bp, Homo sapiens
atgcttacaccctggatgaataaagtctttatttacacctccacctcccc

SEQ ID NO: 5801 - DNA, 50 bp, Homo sapiens
ctcttcacaggtcataagcccctctgagcggcgacagtcctcgcatccag

SEQ ID NO: 5802 - DNA, 50 bp, Homo sapiens
cagctcgacctcagtccccttcagaaataagatggcggctgcgctgacag

SEQ ID NO: 5803 - DNA, 50 bp, Homo sapiens
tttcaacgtgtacctttcctgggaaaccatctcaataaacacattttggt

SEQ ID NO: 5804 - DNA, 50 bp, Homo sapiens
gctggacacatgggttaagaggaggaaaagtaggaaaggaggaggggaaa

SEQ ID NO: 5805 - DNA, 50 bp, Homo sapiens
ggctgggaccagggtttttcaagccaccttttcctgtctcagttcagaga

SEQ ID NO: 5806 - DNA, 50 bp, Homo sapiens
cccactttcacacatgactcacacgactgaaggaaagaaagggcatcctt

SEQ ID NO: 5807 - DNA, 50 bp, Homo sapiens
aagaaattaaggaaggcaagagggtaggtgttggcccatggaagtttccc

SEQ ID NO: 5808 - DNA, 50 bp, Homo sapiens
ctggcaaatattgcggaagatgtactgaaatgtaattgaaatgtagctgc

SEQ ID NO: 5809 - DNA, 50 bp, Homo sapiens
agcataagagatacgaagctgatggtaattaacttgtaccccttgaagtg

SEQ ID NO: 5810 - DNA, 50 bp, Homo sapiens
agtgtcagacaattagatactctttcctgtcttcaggagcccatctggaa

SEQ ID NO: 5811 - DNA, 50 bp, Homo sapiens
gaagtgtaaacatgccaacagggtttatatttaggttccaagagttgcca

SEQ ID NO: 5812 - DNA, 50 bp, Homo sapiens
cttcccaaactccattgtctcattctcactgcttatgttattgctcttat

SEQ ID NO: 5813 - DNA, 50 bp, Homo sapiens
cccacacagcagagaagtatcagaaaacatagaaacatgtgaaaatgcgc

SEQ ID NO: 5814 - DNA, 51 bp, Homo sapiens
aggttcaattcattttcctgagatgtttggtttataagatttgaggatggt

SEQ ID NO: 5815 - DNA, 50 bp, Homo sapiens
atacttagatgtgcttggatcctgggtgggaggcttggttagaagtcacg

SEQ ID NO: 5816 - DNA, 50 bp, Homo sapiens
tgggtcagcgtgttcaattttaaataggaatacactagccttacaacgga

SEQ ID NO: 5817 - DNA, 50 bp, Homo sapiens
tgttcatcttgatgtaatagagaaggaaagagagagcatcccttttcagt

SEQ ID NO: 5818 - DNA, 50 bp, Homo sapiens
accagtaacacaatgacggcaagcacagagaaggaaaaagtcagatcccc

SEQ ID NO: 5819 - DNA, 50 bp, Homo sapiens
acttggagctagagagccacccatcatatggaggagaagtggtcactcta

SEQ ID NO: 5820 - DNA, 50 bp, Homo sapiens
tgcatgtgtgttgtgtacttgtctgttctgtaagattgtcggtgttacac

SEQ ID NO: 5821 - DNA, 50 bp, Homo sapiens
ttcctggcagtaaagaaaagaaagaagatgtgagttatgaagcattgact

SEQ ID NO: 5822 - DNA, 51 bp, Homo sapiens
aaataggaatataatctgtccacatcaaagaatgggaagtcgaagtgtaca

SEQ ID NO: 5823 - DNA, 50 bp, Homo sapiens
gttccaaatgttttccgctaatagtttgtcctaaagcctttgccattcct

SEQ ID NO: 5824 - DNA, 50 bp, Homo sapiens
acagagaaggcttatttacgttgggaattacattaaggaaaagtggtgac

SEQ ID NO: 5825 - DNA, 50 bp, Homo sapiens
ccttcctcctatatcctgccttgaatagggatgtgataccttgagccatg

SEQ ID NO: 5826 - DNA, 50 bp, Homo sapiens
atatttgggtctctgtttaagatttcattgccgtggtagggagagttcca

SEQ ID NO: 5827 - DNA, 50 bp, Homo sapiens
tggatgccatgatgacaccaataagcaacccacagattaggggaaatact

SEQ ID NO: 5828 - DNA, 50 bp, Homo sapiens
ggggctgggagccaccaaaagggcctgctcttcggagaaatgctgaattc

SEQ ID NO: 5829 - DNA, 50 bp, Homo sapiens
aggcatcttgaaagttccataaagacagaagtaagggtcattcagtcatt

SEQ ID NO: 5830 - DNA, 50 bp, Homo sapiens
agctaaagccacggaactcaatgagatttatgcatggaaggaaacaggtt

SEQ ID NO: 5831 - DNA, 50 bp, Homo sapiens
tgttctctctcgaactctggagcacatcagctctctctgcataaactgtt

SEQ ID NO: 5832 - DNA, 50 bp, Homo sapiens
atctggaggatggcagtttgagaattaggactaagcccgtctcccctttg

SEQ ID NO: 5833 - DNA, 50 bp, Homo sapiens
cattagctctctaaacatttggcctaagggattcataggtgaagccttta

SEQ ID NO: 5834 - DNA, 50 bp, Homo sapiens
ggtaggatttatccttttcttcatgtgcaactgtataaactggcaaagca

SEQ ID NO: 5835 - DNA, 50 bp, Homo sapiens
agtcttatgggacagagcagctctccagtctaggatggtagaagattctt

SEQ ID NO: 5836 - DNA, 50 bp, Homo sapiens
gagtctgtacccctttctaataaactgctctggacacaatgaaccctgaa

SEQ ID NO: 5837 - DNA, 50 bp, Homo sapiens
ccatcggcaagccttggtgggttcatattcagtggcattagggattaagg

SEQ ID NO: 5838 - DNA, 50 bp, Homo sapiens
ccatttcttctggatcctctcctagttgtctttgtgtggacgcacaagcg

SEQ ID NO: 5839 - DNA, 50 bp, Homo sapiens
gatcctttgctgacactggtttctctcttattttgccccgccaataaaaa

SEQ ID NO: 5840 - DNA, 51 bp, Homo sapiens
tctgtctgaaacttcttttctctctgagaattaaattttccaatggaccgt

SEQ ID NO: 5841 - DNA, 50 bp, Homo sapiens
gatctgtgttttcctcccaaaagaagatcatctttccagaaaaagaggat

SEQ ID NO: 5842 - DNA, 50 bp, Homo sapiens
ttccatatgtcactgtatctgcctggcattaccccttcttaaaacacaca

SEQ ID NO: 5843 - DNA, 50 bp, Homo sapiens
gctcactaccacttcttcaaatccagctaaaagcatcacggcctcaatga

SEQ ID NO: 5844 - DNA, 50 bp, Homo sapiens
gtctggttgttagctttcccgatcctccacacattggaaacctaagcata

SEQ ID NO: 5845 - DNA, 50 bp, Homo sapiens
gggcaatggagccacagactctctaacttcaagaggtgtttcataggtgt

SEQ ID NO: 5846 - DNA, 50 bp, Homo sapiens
agctgaggtcagacaaaccacaacatatatgcagatttatcagcaataaa

SEQ ID NO: 5847 - DNA, 50 bp, Homo sapiens
cctgccagggttgttcggaagtcgcaggtccgaaaatctcctccgcatac

SEQ ID NO: 5848 - DNA, 50 bp, Homo sapiens
cttctctgaaatggtacgcctatacttgcatttctgagaagccaaacaaa

SEQ ID NO: 5849 - DNA, 50 bp, Homo sapiens
agttttctggctaagtcacctcttaaggagatccctgtaaaattcaccct

SEQ ID NO: 5850 - DNA, 50 bp, Homo sapiens
cagattaaaaaccccatcccggccctcaccgaggtgttacaactctgtcc

SEQ ID NO: 5851 - DNA, 50 bp, Homo sapiens
agcaaattactctgcctggaaataaaattctgtcacttcaagcatctcct

SEQ ID NO: 5852 - DNA, 50 bp, Homo sapiens
tccaggcactgtataggtggcgaggacacaatgataggcaaagtagtaca

SEQ ID NO: 5853 - DNA, 50 bp, Homo sapiens
acagacccaaacctcacagagtgaaaggggactttcctcacagagtgaaa

SEQ ID NO: 5854 - DNA, 51 bp, Homo sapiens
ttgcttcagacttttaacaacaatcctagaagccagaaaacaatgaagaaa

SEQ ID NO: 5855 - DNA, 50 bp, Homo sapiens
ttctgtcagggcttcaaaagagacttccatagttttgggaactggagtca

SEQ ID NO: 5856 - DNA, 50 bp, Homo sapiens
gatatattgaaggtcagaggcagagctaaacaggtgatgccactgggtct

SEQ ID NO: 5857 - DNA, 50 bp, Homo sapiens
aggctcttgttgagtattcctttgattcctgcttctgtctttttaaatca

SEQ ID NO: 5858 - DNA, 50 bp, Homo sapiens
acacaccaaaagaaatagaagagtctttttctgcccttggggaatctgca

SEQ ID NO: 5859 - DNA, 50 bp, Homo sapiens
acacccagcacccacagggaagaaataattccacagagctaagtattcca

SEQ ID NO: 5860 - DNA, 50 bp, Homo sapiens
tgtgcctgtgtgctccagcctcttcctatgtgtgtaacttcaataaaacc

SEQ ID NO: 5861 - DNA, 50 bp, Homo sapiens
accgagtgttaccgcaagaggtgtaaaaatccaggttcatgtttgcacac

SEQ ID NO: 5862 - DNA, 50 bp, Homo sapiens
tcctgattctcaaagtacccccttccctacaactctaacatgctttgtct

SEQ ID NO: 5863 - DNA, 50 bp, Homo sapiens
ccatgatttttccaatggacaagcactattaacatgggactgtatttcct

SEQ ID NO: 5864 - DNA, 50 bp, Homo sapiens
aatagaactgatagcccatgatgattggctggcagggttaaggaagtggg

SEQ ID NO: 5865 - DNA, 50 bp, Homo sapiens
tcccaggagagtcacatttctttttcactaaataaggaggggaagaaaaa

SEQ ID NO: 5866 - DNA, 50 bp, Homo sapiens
gggttacctcactttctaggttcccaagattcccaagttaaggaagcttt

SEQ ID NO: 5867 - DNA, 50 bp, Homo sapiens
aaagcgtccagtccccctaactcaaacacagaaacataacaattttacaa

SEQ ID NO: 5868 - DNA, 50 bp, Homo sapiens
cccagggctcctccacctgaaagaattgtcagggtttcagatcagctaaa

SEQ ID NO: 5869 - DNA, 50 bp, Homo sapiens
tggcctccacccattaaactgtctttgcctaagacaaataattcccagga

SEQ ID NO: 5870 - DNA, 50 bp, Homo sapiens
tgtactcctgatgcctgaaaatcgttaagtgaagacttatcacattaccg

SEQ ID NO: 5871 - DNA, 50 bp, Homo sapiens
atccttcagattgagctgggtgtcagcattcaattccacaaggctacctg

SEQ ID NO: 5872 - DNA, 50 bp, Homo sapiens
tggataagcaatatgttggactagtatgaaaatggcattcccagcagtga

SEQ ID NO: 5873 - DNA, 50 bp, Homo sapiens
tcactagcagaatatagtgggcatgaccagtatcctagtagagctgaccc

SEQ ID NO: 5874 - DNA, 50 bp, Homo sapiens
agtttctttcttacaatgggggtctgaaatccagggtttccacaccaggg

SEQ ID NO: 5875 - DNA, 50 bp, Homo sapiens
ccaaatacttagtgtagttgacttgtcttgggttgcactgtaaggcagag

SEQ ID NO: 5876 - DNA, 50 bp, Homo sapiens
caagagtttccatgcgtccagtgatgaccggaattaatcatgtatggtgt

SEQ ID NO: 5877 - DNA, 51 bp, Homo sapiens
gtttctaacccataagtgcctcatacatacattgctagtctaaagagcttt

SEQ ID NO: 5878 - DNA, 50 bp, Homo sapiens
accggctaattttgtaactggcttgtttgtaaaataaatccttcctgtgt

SEQ ID NO: 5879 - DNA, 50 bp, Homo sapiens
tggtgggactatgtgttattcttgtatacttgcagtgggtagatgtcact

SEQ ID NO: 5880 - DNA, 50 bp, Homo sapiens
acttccctacctcacaggttaggattcaaagtgtgtattcccccattgtg

SEQ ID NO: 5881 - DNA, 50 bp, Homo sapiens
gggtgctttacaggattcttggaaatgtgtagtggatgctggctctaggg

SEQ ID NO: 5882 - DNA, 50 bp, Homo sapiens
acagaagcagggggtcagaaagtttcataaaggaggtgtcttggaacaaa

SEQ ID NO: 5883 - DNA, 50 bp, Homo sapiens
ctattgtgtgggttgccttgtcctactcaacttcaaatattcaccacccc

SEQ ID NO: 5884 - DNA, 50 bp, Homo sapiens
caggtgtgcttactggcaggaaccgagggaataaataaagatcactggaa

SEQ ID NO: 5885 - DNA, 50 bp, Homo sapiens
accagccttatgtgtgtgggtattcaatactctgcacattatatactgta

SEQ ID NO: 5886 - DNA, 50 bp, Homo sapiens
gggcatttgttaccccctcctcaccaccatccccattaaaggcttcgggg

SEQ ID NO: 5887 - DNA, 50 bp, Homo sapiens
ctgtatctacaactcctgacttcagatttttgctttcttcaaaacagcct

SEQ ID NO: 5888 - DNA, 50 bp, Homo sapiens
agcaagacttaaccactaattactattatctgacccaggaaaactccgcc

SEQ ID NO: 5889 - DNA, 50 bp, Homo sapiens
tggatagttgctcaatgtagcagtgatgttcttggaattgccagcagagc

SEQ ID NO: 5890 - DNA, 50 bp, Homo sapiens
ccaacagattcgtgcttaccctgaggtgaagcctcgtttgagaaccaaat

SEQ ID NO: 5891 - DNA, 50 bp, Homo sapiens
caaccttcttgttgaattgatttactactcatcagggtcatgcacaagca

SEQ ID NO: 5892 - DNA, 50 bp, Homo sapiens
acattcaaactgccagaatatgactgtaaaacagcgaagtgttctcttgc

SEQ ID NO: 5893 - DNA, 50 bp, Homo sapiens
tcttcctgggaatgtgatgtgtttttcactggttctaattctgtcttcct

SEQ ID NO: 5894 - DNA, 50 bp, Homo sapiens
acttattaattctcacctcagcctcagggatgtatgtagggaaggagcat

SEQ ID NO: 5895 - DNA, 50 bp, Homo sapiens
acattcctgtcattagtgaataagaagctgaggtgtgactaagaagacaa

SEQ ID NO: 5896 - DNA, 52 bp, Homo sapiens
cctccttgataaaatcaagaacaggttagattaaagcagtaaatcctagact

SEQ ID NO: 5897 - DNA, 50 bp, Homo sapiens
tcctggcctttgtgggtttttaattccctttaccttttccctttttggat

SEQ ID NO: 5898 - DNA, 50 bp, Homo sapiens
actgctgcaactacaattctcagatagtcccatttgtttaaatcacgcat

SEQ ID NO: 5899 - DNA, 50 bp, Homo sapiens
ccttccctcttgcctgtaggttctgtggctataaacaaatcataactttt

SEQ ID NO: 5900 - DNA, 50 bp, Homo sapiens
ttaaatgcttccctggctctccctgggtttcagtttctatccatgccctg

SEQ ID NO: 5901 - DNA, 50 bp, Homo sapiens
ttgttctcctcccaagtctctggttctatttggctttttcagctctgtgc

SEQ ID NO: 5902 - DNA, 50 bp, Homo sapiens
gcatttcagggacacaaatggtccatggcagagaccagtaatgccagata

SEQ ID NO: 5903 - DNA, 50 bp, Homo sapiens
ttttatccccgctttaactttgtttgcttggtacttttcttgtggttaca

SEQ ID NO: 5904 - DNA, 50 bp, Homo sapiens
cacgcacccaactccccactgctcctctccatccagatgttcgtccagag

SEQ ID NO: 5905 - DNA, 50 bp, Homo sapiens
tttgagggcaatttaatggttaagtgtaggaaaatccactcttacagtgt

SEQ ID NO: 5906 - DNA, 50 bp, Homo sapiens
ggccttttgattttccattggggtcccccgctttcccatttttggttttt

SEQ ID NO: 5907 - DNA, 50 bp, Homo sapiens
gacagtttggggaagggattgaaggtctgcgtcaaagagaacagaaaacc

SEQ ID NO: 5908 - DNA, 51 bp, Homo sapiens
aggggccttttaccggtttgttttcccttaaatttttaaaggaattgaatt

SEQ ID NO: 5909 - DNA, 50 bp, Homo sapiens
tcctctttcttgtcactgtgaagcgatgaataaacctgggtgtagatcca

SEQ ID NO: 5910 - DNA, 50 bp, Homo sapiens
cctagaaattattatacagggataaatgaggcactgaaggtgggagaacc

SEQ ID NO: 5911 - DNA, 50 bp, Homo sapiens
acgacaaactgcacagtaaatatcacaaacacggaaataccacagtgtct

SEQ ID NO: 5912 - DNA, 50 bp, Homo sapiens
accatgacttggcaaagagtttcaagagagggcataatcaaaagtaacca

SEQ ID NO: 5913 - DNA, 50 bp, Homo sapiens
gattaatcaagggaagagcttcaagcagagctccttaggtttttcaaaaa

SEQ ID NO: 5914 - DNA, 50 bp, Homo sapiens
gctcaggggacagctattctttttcaaagcgtttaccgactggatcacct

SEQ ID NO: 5915 - DNA, 50 bp, Homo sapiens
tgagagctttccttcctcctacgatccaaccatgtcaaacatttcctaca

SEQ ID NO: 5916 - DNA, 50 bp, Homo sapiens
tgtgccaacgcatgatttctttgagtaaatttctaaacgtcacagaagtt

SEQ ID NO: 5917 - DNA, 50 bp, Homo sapiens
agtcaacatggagcaagtgagctaaggaagtaatggaaactgtttggaga

SEQ ID NO: 5918 - DNA, 50 bp, Homo sapiens
agctcaggtcttccctcatctgttagtttcctggagtctgttctcatact

SEQ ID NO: 5919 - DNA, 50 bp, Homo sapiens
aaacatactcctcttcaccagcactcagacatttgtatccagagaaagct

SEQ ID NO: 5920 - DNA, 50 bp, Homo sapiens
agtctgtcaattgtttaagcctgtgatctttcttttcccagttaagagtt

SEQ ID NO: 5921 - DNA, 50 bp, Homo sapiens
tgtcctctcaaccctacttgtggttttacactgttaattacactatttgc

SEQ ID NO: 5922 - DNA, 50 bp, Homo sapiens
gtgtgtgtatggttgttgggcgtaggacaggtttcggggatgcgcggtac

SEQ ID NO: 5923 - DNA, 50 bp, Homo sapiens
ctgtgcttgactattgaaaacttagaattgggatgccaaagttacttcct

SEQ ID NO: 5924 - DNA, 50 bp, Homo sapiens
ggttgtatcaaaagaactccacatccatattgaataaactcccactagcc

SEQ ID NO: 5925 - DNA, 50 bp, Homo sapiens
ggctgcccagatctcgtgggaagaagaccacaggaggactcggctcaatg

SEQ ID NO: 5926 - DNA, 50 bp, Homo sapiens
tggaaaaatgatagcagccaacttgacagaagaacccagcatacacattc

SEQ ID NO: 5927 - DNA, 50 bp, Homo sapiens
ttggttttggggattgggaagtcttaagccaaattgtccccggtctcccc

SEQ ID NO: 5928 - DNA, 50 bp, Homo sapiens
gccctatatctagtgagcaggttgtggcaatcaggaagggattgatattt

SEQ ID NO: 5929 - DNA, 50 bp, Homo sapiens
tgcacgcaatgcttgaagtgttcccaggtatttagtttcaggtaaatttt

SEQ ID NO: 5930 - DNA, 50 bp, Homo sapiens
ctgtaggtatgagctgccaggatccaggtgtgactcgggtatttctaggg

SEQ ID NO: 5931 - DNA, 50 bp, Homo sapiens
tcccatttggggggtgggctgtttaaattttgactccctgttttaaaccc

SEQ ID NO: 5932 - DNA, 50 bp, Homo sapiens
ccacttgcatctcttctgggggttctttcctttctttcctgttctaaggc

SEQ ID NO: 5933 - DNA, 50 bp, Homo sapiens
tgggtaatcaacactcaaccatcaacaaacactctctattccaggcactg

SEQ ID NO: 5934 - DNA, 50 bp, Homo sapiens
aggagaaataattagagtggcacactagcatgatggtaaacattctgtca

SEQ ID NO: 5935 - DNA, 50 bp, Homo sapiens
aggagttcaagaagcagagatttccaggtccatgcaccaaagctcatgtg

SEQ ID NO: 5936 - DNA, 50 bp, Homo sapiens
cttgtcctctcctgatccagggctccagtgcccatgtccagtgccttggt

SEQ ID NO: 5937 - DNA, 50 bp, Homo sapiens
gcatctccccgctgtcagcctcagccctctcctaccaaaatctctttcga

SEQ ID NO: 5938 - DNA, 50 bp, Homo sapiens
ggcgtttcccattgaccagtttgaccctggtttgaataaagagaagtgcg

SEQ ID NO: 5939 - DNA, 50 bp, Homo sapiens
agcccattgaaaaccttggcaaaatgtcagaccttaagactttccactat

SEQ ID NO: 5940 - DNA, 50 bp, Homo sapiens
tcagagacaacggaagctgaaaaataagagctgagaaaggaagaactttt

SEQ ID NO: 5941 - DNA, 50 bp, Homo sapiens
atatacatacaaatctaagctccaagaagcctaagaaaaccccttagggg

SEQ ID NO: 5942 - DNA, 50 bp, Homo sapiens
gggcaatttacatcgggactcgtttcatctctagaccttcacttacctga

SEQ ID NO: 5943 - DNA, 50 bp, Homo sapiens
agctctggagtgcccctccctccaaataaagtattttaagcgaacactga

SEQ ID NO: 5944 - DNA, 50 bp, Homo sapiens
gccagtctctatgtgtcttaatcccttgtccttcattaaaagcaaaacta

SEQ ID NO: 5945 - DNA, 50 bp, Homo sapiens
ccctcaggcatagaaattgaatctgaaatggctgatgaataagcaaaggc

SEQ ID NO: 5946 - DNA, 50 bp, Homo sapiens
cagccctgcctgagtttttgacacctgcatccctccctgcctcacctcac

SEQ ID NO: 5947 - DNA, 50 bp, Homo sapiens
agagcaggagaaatcctactgcattattaatctgaaagcacaaggacagc

SEQ ID NO: 5948 - DNA, 50 bp, Homo sapiens
ctgtcttggtttgtatgggaaaatctgcgggttgtggaatattaggttct

SEQ ID NO: 5949 - DNA, 50 bp, Homo sapiens
tgggattatagggggagacaggagttgtggaattacaggagaggttcact

SEQ ID NO: 5950 - DNA, 50 bp, Homo sapiens; identical to SEQ ID NO: 5949

SEQ ID NO: 5951 - DNA, 50 bp, Homo sapiens
ctgagaaaaggagtgtctctcttctgctcccaaacttccagtagcttcca

SEQ ID NO: 5952 - DNA, 50 bp, Homo sapiens
tcgaggttcttcccaagaaaagcccaatcttataaactgttacttcccct

SEQ ID NO: 5953 - DNA, 50 bp, Homo sapiens
tgcaatgaggcagtggggtaaggttaaatcctctaaccgtctttgaatca

SEQ ID NO: 5954 - DNA, 50 bp, Homo sapiens
tggcaacttcaactccttgatggcgataatctctggtatgaatatgagcc

SEQ ID NO: 5955 - DNA, 50 bp, Homo sapiens
ttgtgctcctgatacgacgttgccacagttaatccgttctgatctctgct

SEQ ID NO: 5956 - DNA, 50 bp, Homo sapiens
caagcctaactttccaacactcccgcgacgcaaccccttcccctttcctc

SEQ ID NO: 5957 - DNA, 50 bp, Homo sapiens
cacggttagagtcaccaaacctgtatttcaggggacatctttccagctcc

SEQ ID NO: 5958 - DNA, 50 bp, Homo sapiens
ccaaaggctcactacccctgtgcgttgtccagcacacagacactatgtgc

SEQ ID NO: 5959 - DNA, 50 bp, Homo sapiens
tgcttgggaaatttggtttgtaaacctaaaatagcccttatttctgggga

SEQ ID NO: 5960 - DNA, 50 bp, Homo sapiens
catctgctgagcagtgtgctgtgtcaacctcctcctaggtctcctctatg

SEQ ID NO: 5961 - DNA, 50 bp, Homo sapiens
ctttctgcctgaagctgcccccatgactcccttctttgtgcaaaagcatg

SEQ ID NO: 5962 - DNA, 50 bp, Homo sapiens
gaaatgagttggtgtcttcacagaatgaggatccccagagccatcttgcc

SEQ ID NO: 5963 - DNA, 50 bp, Homo sapiens
gtctccctcccactctctgccttacctggtatctatgactcgactgaaat

SEQ ID NO: 5964 - DNA, 50 bp, Homo sapiens
tgcgagaggaagcagagaccaccttgaaactcgggtgcattaagtccttg

SEQ ID NO: 5965 - DNA, 50 bp, Homo sapiens
ttagccactgctattctaggttccttgatggagccccactcccacgccta

SEQ ID NO: 5966 - DNA, 50 bp, Homo sapiens
accacccagaggttgctggcttccttaataaagctaactttcctttcacc

SEQ ID NO: 5967 - DNA, 50 bp, Homo sapiens
aggggagccagtggtttttggtcatgggaagtgttctcataaaattcatt

SEQ ID NO: 5968 - DNA, 50 bp, Homo sapiens
gcaccagacttctgaacaggctgggagagtgaggcataaacacatgaaat

SEQ ID NO: 5969 - DNA, 50 bp, Homo sapiens
acacagtactttgttgagatgttggcttcttggtttatggcatgaattct

SEQ ID NO: 5970 - DNA, 50 bp, Homo sapiens
acttatcttttgccacccatgttcctggatgccttgccttcctctttcat

SEQ ID NO: 5971 - DNA, 50 bp, Homo sapiens
aaacaggaagcctctcatgaatttgaccaaggagctacattcgttctcta

SEQ ID NO: 5972 - DNA, 50 bp, Homo sapiens
tgaggaagaggagatttattaagccccttcttttaggctaggaggtttcc

SEQ ID NO: 5973 - DNA, 50 bp, Homo sapiens
ggacactggcttttgtgcagctcttcatcacagagtctgttgagctacaa

SEQ ID NO: 5974 - DNA, 50 bp, Homo sapiens
acagtgattttcaaccaaggggctttttcaaactacattccttagctccc

SEQ ID NO: 5975 - DNA, 50 bp, Homo sapiens
ggtggtggctacaagggtgattgccttatgataattgaccgtgtcataat

SEQ ID NO: 5976 - DNA, 50 bp, Homo sapiens
agctgggaggccattactttttgtctgagtcttctggagttctagcaaaa

SEQ ID NO: 5977 - DNA, 50 bp, Homo sapiens
agttgcattaaactgagcttagatgtgtaagtttgctaacggatgggttt

SEQ ID NO: 5978 - DNA, 50 bp, Homo sapiens
cctctaaggcatttatttactgacaacataaaatcttgaaccccaggtca

SEQ ID NO: 5979 - DNA, 50 bp, Homo sapiens
tcacctccatcaacttactagcacataaagggtgggatttcatgtgttga

SEQ ID NO: 5980 - DNA, 50 bp, Homo sapiens
ctggcaaaggcatgggtacaacctgctctgtgatctaccttctgaaccac

SEQ ID NO: 5981 - DNA, 50 bp, Homo sapiens
acacctgtggtatatttgtatcattcagtctggtttctcacccttcctaa

SEQ ID NO: 5982 - DNA, 50 bp, Homo sapiens
aaccctcgtaaggtttcatcttccttgattgcaaaatgagtttgtgtgaa

SEQ ID NO: 5983 - DNA, 50 bp, Homo sapiens
cccgcttcaccttccctaaataactcgtttgcaggctaattccatcaaat

SEQ ID NO: 5984 - DNA, 50 bp, Homo sapiens
attttgctcattacctgtcaggagaaaaccctccttccccagtctccact

SEQ ID NO: 5985 - DNA, 50 bp, Homo sapiens
acctactgaatctccagattgccaagtgaaacacaatggttgcctcttca

SEQ ID NO: 5986 - DNA, 50 bp, Homo sapiens
tgcgaaagctaattccctagtatgaataaacttcagaccttgctctcctt

SEQ ID NO: 5987 - DNA, 50 bp, Homo sapiens
agcctgaggtgggtgaagaaaatacctgctttatactgttctggaaactc

SEQ ID NO: 5988 - DNA, 50 bp, Homo sapiens
cttttccccttcatggtagttgctgcttaagtttctctaacatgcctgca

SEQ ID NO: 5989 - DNA, 50 bp, Homo sapiens
tgaatgtgcagatgcagaacccattgatatggagggctgagtgtctgaaa

SEQ ID NO: 5990 - DNA, 51 bp, Homo sapiens
tgtactacttatttatgtgtaaaccatacacagggctagaaaggaagggat

SEQ ID NO: 5991 - DNA, 50 bp, Homo sapiens
tgtagaattgcggagtagaaagacccttgaaagatcatttgtcctgtggt

SEQ ID NO: 5992 - DNA, 50 bp, Homo sapiens
gctcaagttcccagcacctggggaattctaagcctgaggaagacaaggtg

SEQ ID NO: 5993 - DNA, 50 bp, Homo sapiens
tgtttttatgtcctgagcaagcaaattgctgcaattaaaatcaccaattt

SEQ ID NO: 5994 - DNA, 51 bp, Homo sapiens
aggcctgatattgaaagcttttgatactgagatcctattaatctcagatga

SEQ ID NO: 5995 - DNA, 50 bp, Homo sapiens
tgttagtttgcttttgaaattctttggagggtactcttcagggcttcaca

SEQ ID NO: 5996 - DNA, 51 bp, Homo sapiens
tagtgattatctccaggaatcaagtacaaactttgaaaaaagactggaggt

SEQ ID NO: 5997 - DNA, 50 bp, Homo sapiens
tttgtcccaagggctcagactgaaagaatgcaatgtgagaggtatgccac

SEQ ID NO: 5998 - DNA, 50 bp, Homo sapiens
tctgtgaaaatctttctgcaaatgtctttgcttgcttgtactcacgtttt

SEQ ID NO: 5999 - DNA, 50 bp, Homo sapiens
tgtctttaacgcacagatgttacttcagcaccacaaggactgttgatgga

SEQ ID NO: 6000 - DNA, 50 bp, Homo sapiens
cagtcagatgttggaattgggggtagagggattatagagttgtgtgtgct

SEQ ID NO: 6001 - DNA, 50 bp, Homo sapiens
aaaggagggactatggcatcaaacagcctcttcagcacagtgacaccatg

SEQ ID NO: 6002 - DNA, 50 bp, Homo sapiens
acccagtttgtgcatagttcatgatcctctataaaaccagcttttgtgga

SEQ ID NO: 6003 - DNA, 50 bp, Homo sapiens; identical to SEQ ID NO: 4877

SEQ ID NO: 6004 - DNA, 50 bp, Homo sapiens
tggaatggactcttaaaacaatgaaagagcatttatcgtttgtcccttga

SEQ ID NO: 6005 - DNA, 50 bp, Homo sapiens
tcactaccttcaattgtttacaaggtggatatgggcaggcaacagatact

SEQ ID NO: 6006 - DNA, 50 bp, Homo sapiens
ctaggccggatgggccagagaaggagaaccatggcaggagccggaagcag

SEQ ID NO: 6007 - DNA, 50 bp, Homo sapiens
aaatgttgagcaactgttcaataacagcactaattgtgtgttcattggct

SEQ ID NO: 6008 - DNA, 50 bp, Homo sapiens
ctggcacatccaggttttagagcaggcagcctgagatttcaaaaatgagg

SEQ ID NO: 6009 - DNA, 50 bp, Homo sapiens
ggagcggaatacagtaaaagcactggactgacctaagagtttgtttctgc

SEQ ID NO: 6010 - DNA, 50 bp, Homo sapiens
acaccatttcagcgttggatcacagacagctcttcctttatatcccagca

SEQ ID NO: 6011 - DNA, 50 bp, Homo sapiens
ccaccttgctgccttttgaaacactcaggaaatatagttggctaaaactg

SEQ ID NO: 6012 - DNA, 50 bp, Homo sapiens
cacttcgcaacggagtgtttgaaattgtggtggtcctgatttataggatt

SEQ ID NO: 6013 - DNA, 50 bp, Homo sapiens
gctttggcagatggattaaccttgttcttttggagccagatcaatatcta

SEQ ID NO: 6014 - DNA, 50 bp, Homo sapiens
agaatgcctggttttcgtttgcaatttgcttgtgtaaatcaggttgtaaa

SEQ ID NO: 6015 - DNA, 50 bp, Homo sapiens; identical to SEQ ID NO: 1006

SEQ ID NO: 6016 - DNA, 50 bp, Homo sapiens
tgcaagtggatggtttggtatcactgtaaataaaaagagggcctgggaaa

SEQ ID NO: 6017 - DNA, 50 bp, Homo sapiens
gtggcttttctgttgacgccaaaggttactccctctgcctcaccataaaa

SEQ ID NO: 6018 - DNA, 50 bp, Homo sapiens
acctcctacgtctgttttctggctgtggtgacttgggatttttaacctta

SEQ ID NO: 6019 - DNA, 50 bp, Homo sapiens
atcgttggattatctttgaacccccttgtgtggatcattttgagccgcct

SEQ ID NO: 6020 - DNA, 50 bp, Homo sapiens
agctccaaagtggtttgatgaccacaggctaaaattcatagtcttaaaat

SEQ ID NO: 6021 - DNA, 50 bp, Homo sapiens
tcagaaaggagaaaacacagaccaaagagaagtatctaagaccaaaggga

SEQ ID NO: 6022 - DNA, 50 bp, Homo sapiens
gcatcacgatttgtctacataagtccagttcatctcgcgtttgttttggc

SEQ ID NO: 6023 - DNA, 50 bp, Homo sapiens
atacagggttccatccagaaagcattcagtcagagcaagttaaagtcagt

SEQ ID NO: 6024 - DNA, 50 bp, Homo sapiens
aagtgccagattttgataatcaccagcctctcattcaactcctatgttgc

SEQ ID NO: 6025 - DNA, 50 bp, Homo sapiens
acccttggtcactggtgtttcaaacattctggcaagtcacatcaatcaag

SEQ ID NO: 6026 - DNA, 50 bp, Homo sapiens
agctctggagcctttgcttcctcaaatacgagcgggaactgcgttgagcg

SEQ ID NO: 6027 - DNA, 50 bp, Homo sapiens
aagttgtcctgtgctaaagcaagcgtgggatgatcctacctacctctagg

SEQ ID NO: 6028 - DNA, 50 bp, Homo sapiens
atttggacagatgcagaaggaactgttagtgagtcaagacaaacacatct

SEQ ID NO: 6029 - DNA, 50 bp, Homo sapiens
cccctacccctggaaagtaatatactgaagtctcatcatactgttttggg

SEQ ID NO: 6030 - DNA, 50 bp, Homo sapiens; identical to SEQ ID NO: 1043

SEQ ID NO: 6031 - DNA, 50 bp, Homo sapiens
agctagtgatgttttgtccaaaggaagattctgacaacagcttcagcaga

SEQ ID NO: 6032 - DNA, 50 bp, Homo sapiens
acacagacatattgaccgcacacaacactgaaatggactgacttgagaaa

SEQ ID NO: 6033 - DNA, 50 bp, Homo sapiens; identical to SEQ ID NO: 4348

SEQ ID NO: 6034 - DNA, 50 bp, Homo sapiens
ggtccatgtcaccgtgagtacacccctatgattggtttgttgtcaagaag

SEQ ID NO: 6035 - DNA, 50 bp, Homo sapiens
tgctagttcaggtcctccaggcattgatttgtacagttaaactccgagtg

SEQ ID NO: 6036 - DNA, 50 bp, Homo sapiens; identical to SEQ ID NO: 4210

SEQ ID NO: 6037 - DNA, 50 bp, Homo sapiens
ggcctactgaccaaattgttgtgttgagatgatatttaactttttgccaa

SEQ ID NO: 6038 - DNA, 50 bp, Homo sapiens; identical to SEQ ID NO: 4297

SEQ ID NO: 6039 - DNA, 50 bp, Homo sapiens
cgatagaattgaagcagtccacggggaggggatgatacaaggagtaaacc

SEQ ID NO: 6040 - DNA, 50 bp, Homo sapiens
atagactccaaagaggcgttaagcacctggttttcctttggctcagaaaa

SEQ ID NO: 6041 - DNA, 50 bp, Homo sapiens
ctcaaacgaaattgggcaggccatttgcgtggtttctctggataagttcc

SEQ ID NO: 6042 - DNA, 50 bp, Homo sapiens
gcacatgacagtaagcgaggttttgggtaaatatagatgaggatgcctat

SEQ ID NO: 6043 - DNA, 50 bp, Homo sapiens
tcccagagtaactgacagtatcaaatagcaagagagttaggatgaggact

SEQ ID NO: 6044 - DNA, 50 bp, Homo sapiens
acacaggaaccgcttacccaccagctctgcccgcgtctctaccgccatag

SEQ ID NO: 6045 - DNA, 50 bp, Homo sapiens
ttcttccaagagaataaccctattaaaggctaaaaatggaagctcccagt

SEQ ID NO: 6046 - DNA, 50 bp, Homo sapiens
actgacctagcagatgtgtggaaaaggaatcagatcttgattcttctggg

SEQ ID NO: 6047 - DNA, 50 bp, Homo sapiens
acaactcaagtgaaaagatgtctccagtttctgaagataacgcacgctga

SEQ ID NO: 6048 - DNA, 50 bp, Homo sapiens
cgccgactcgttgaaagttttgttgtgtagttggttttcgttgagttctt

SEQ ID NO: 6049 - DNA, 50 bp, Homo sapiens
cacccacctggtaggaaggtcaatcttatgctcagaagtcccacccacca

SEQ ID NO: 6050 - DNA, 50 bp, Homo sapiens
caactccttaaagggttgaaggttgtgacaataactgagggaactgatgt

SEQ ID NO: 6051 - DNA, 50 bp, Homo sapiens
aaaacactccacctaaaagcaggaaagatggcaattctaaatagcagcta

SEQ ID NO: 6052 - DNA, 53 bp, Homo sapiens
ggaggttttgatcgtgactttattttgagatattgtatctttgttagtattgc

SEQ ID NO: 6053 - DNA, 50 bp, Homo sapiens
ttgtaaggttccggggaactgactcaacatggttctccaactcgaggttg

SEQ ID NO: 6054 - DNA, 50 bp, Homo sapiens
tgtgagtgttataggttacagtggattccaaactagccacaagtgaagca

SEQ ID NO: 6055 - DNA, 50 bp, Homo sapiens
tcagccaggaggaaaagcactctgattatgaattgagcagaaggaaacaa

SEQ ID NO: 6056 - DNA, 50 bp, Homo sapiens
gttcccactcgttcttgccggagaaacctgccttttcaagcataattcaa

SEQ ID NO: 6057 - DNA, 50 bp, Homo sapiens
gggtccaagattattgattaatttgggcaccgcgagagctcgagtccccc

SEQ ID NO: 6058 - DNA, 50 bp, Homo sapiens
gaccacctgtaaagcaagtcctttcaagtttcactgcacatcccaaacca

SEQ ID NO: 6059 - DNA, 50 bp, Homo sapiens
tggtccactgtcactgtttctctgctgttgcaaatacatggataacacat

SEQ ID NO: 6060 - DNA, 50 bp, Homo sapiens
agactctggaaaaggagggtcggagtattaaactggctgggaatgagagg

SEQ ID NO: 6061 - DNA, 50 bp, Homo sapiens
tgagagcacaccataaattcacagcaggaataaacgaagacacacgagca

SEQ ID NO: 6062 - DNA, 50 bp, Homo sapiens
acattctctcattttgctgaagctgatttgattgggtgtctgtttctcgc

SEQ ID NO: 6063 - DNA, 50 bp, Homo sapiens
tgagaaggtaaagtagaaagggaagatgatgagtgaacaataagccttgt

SEQ ID NO: 6064 - DNA, 50 bp, Homo sapiens
acattattccatgggaataagtcatcagtgcaaaggactgtaaggagtgc

SEQ ID NO: 6065 - DNA, 50 bp, Homo sapiens
cgccgctcctggagacctgataacttaggcttgaaataattgacttgtct

SEQ ID NO: 6066 - DNA, 50 bp, Homo sapiens
tgtatgtgcaatatgcttatgggtaattatgggcaagagaaatggaaaca

SEQ ID NO: 6067 - DNA, 50 bp, Homo sapiens
accccttggtaaagcagttgtaagaattaaacaagaggaattgctctttc

SEQ ID NO: 6068 - DNA, 50 bp, Homo sapiens
aaatcaggccccttgcgccattcacaaaaatccttgtgagatgactcaag

SEQ ID NO: 6069 - DNA, 50 bp, Homo sapiens
agggcagaggtcctttgggagggtaagctcacaaaaactcagggaggcag

SEQ ID NO: 6070 - DNA, 50 bp, Homo sapiens
tcatctccgccaaggttcccactaggcaggaaaggatttttatctaaagt

SEQ ID NO: 6071 - DNA, 50 bp, Homo sapiens
ccacccaagtcggaatccgagtgaaataaatagcatcgcccgccaactac

SEQ ID NO: 6072 - DNA, 50 bp, Homo sapiens
aggcacacgattgtcaccatttctccctttacaagctgtataatcagtaa

SEQ ID NO: 6073 - DNA, 50 bp, Homo sapiens
gcaacgtctgaatgtagtaatgtgactcagagcttcaaagtaagcattcg

SEQ ID NO: 6074 - DNA, 50 bp, Homo sapiens
gccaccccatctgggaggcccagcatccaattcagtcgccttcaatgatt

SEQ ID NO: 6075 - DNA, 50 bp, Homo sapiens
tgatagactggatgctgctatggtaatctgcctcaggaaaatgccggact

SEQ ID NO: 6076 - DNA, 50 bp, Homo sapiens
tggagccaagaagccactgactcaagaggatttcaagcgagagctgcttg

SEQ ID NO: 6077 - DNA, 50 bp, Homo sapiens
caacttttgtaacaggggacttagccgggggcaggaggggttcttgagac

SEQ ID NO: 6078 - DNA, 50 bp, Homo sapiens
acttgaaggcacatcttccttttggttgttttccatcttcaaattaaact

SEQ ID NO: 6079 - DNA, 51 bp, Homo sapiens
taaaaactgacatgacatgagatggtttaagtgtcaaacataagggtcttt

SEQ ID NO: 6080 - DNA, 50 bp, Homo sapiens
actgacataagcccacttcaggtgtttggaagacactaaagagaatcaga

SEQ ID NO: 6081 - DNA, 50 bp, Homo sapiens
gcagctttttgctggcgggggtctaaataaagtagcttccccaaaagaaa

SEQ ID NO: 6082 - DNA, 50 bp, Homo sapiens
acctggttatctcgcaatgacctagctaacacaaatgcaacatcagccgg

SEQ ID NO: 6083 - DNA, 50 bp, Homo sapiens
tgatcaaaatgaagatgctccaaccgtataaatggcagatgaaatagact

SEQ ID NO: 6084 - DNA, 50 bp, Homo sapiens
gcaggagagaaataccttctaatgggtgtggacactggaggaactgttac

SEQ ID NO: 6085 - DNA, 50 bp, Homo sapiens
agggcactgtttgttcctttaatatggagaaatatcgcaaataactggga

SEQ ID NO: 6086 - DNA, 50 bp, Homo sapiens
ttggcctatgttaatttctattctcagttcttctgtgcccttcctcctct

SEQ ID NO: 6087 - DNA, 50 bp, Homo sapiens
gaacgtaagcccgacgctaggcagtgctgttagaaagtgatttggaagag

SEQ ID NO: 6088 - DNA, 50 bp, Homo sapiens
atcccattctccctctcaaggcaggggtcatagatcctaagccataaaat

SEQ ID NO: 6089 - DNA, 50 bp, Homo sapiens
tgctgtaaaatggcagctccataggaacctattttccataggaacctgca

SEQ ID NO: 6090 - DNA, 50 bp, Homo sapiens
actggagaaaggtgtcttcctgtcctttcaggggctcctgcggggaattc

SEQ ID NO: 6091 - DNA, 50 bp, Homo sapiens
attatatttgtccctatcagaatcctcgaatccctagcagccagtccctg

SEQ ID NO: 6092 - DNA, 50 bp, Homo sapiens
tgctcactgtcttctggaagagacaagcactttcttgaaattcctaagca

SEQ ID NO: 6093 - DNA, 50 bp, Homo sapiens
caatcggatcattcttctcaacttgggcggctctttcctcccttccttcc

SEQ ID NO: 6094 - DNA, 50 bp, Homo sapiens
tgctttgggcagtagctgaagccgaagtatgaacagtccattttgtttct

SEQ ID NO: 6095 - DNA, 50 bp, Homo sapiens
cacagttgagtaggaggtcatgaagaagaagagatgatacctgccttacc

SEQ ID NO: 6096 - DNA, 50 bp, Homo sapiens
tttgtgtagcaaatgttcattaattgcctactttgtgccaaattcaggcc

SEQ ID NO: 6097 - DNA, 50 bp, Homo sapiens
tccagcattgtattgtctattgacacacaaagtttgaaaataaaggggca

SEQ ID NO: 6098 - DNA, 50 bp, Homo sapiens
cacccaccagaccgaggattccaaaagggggcgaaggcggagagcaaagg

SEQ ID NO: 6099 - DNA, 50 bp, Homo sapiens
tggactctgttttcaagaggaagaaacaactgacaaataagttgatgtca

SEQ ID NO: 6100 - DNA, 50 bp, Homo sapiens
atgttgaaactggttttaacttgtaatggtgtggctgatgttacccgacc

SEQ ID NO: 6101 - DNA, 50 bp, Homo sapiens
acacagatttgaagtctactgttctaaatggcctctacttcctgctgtca

SEQ ID NO: 6102 - DNA, 50 bp, Homo sapiens
ggaacttctgcttccacttacgatgaaggaacttgtactcaatccatcca

SEQ ID NO: 6103 - DNA, 50 bp, Homo sapiens
gaagccttcctgtggtcataacaagtctcacacaccccaaggactgatct

SEQ ID NO: 6104 - DNA, 50 bp, Homo sapiens
gagtccagcctttgaacctggcgctgaatcctgactttactgcttattca

SEQ ID NO: 6105 - DNA, 50 bp, Homo sapiens
aaactcatacatgcagaaaattgtctttgctcgaaatggtaatgccaaaa

SEQ ID NO: 6106 - DNA, 50 bp, Homo sapiens; identical to SEQ ID NO: 6105

SEQ ID NO: 6107 - DNA, 50 bp, Homo sapiens
acaaaagtcatggctgtgaggctatcattacccttttaccaaagttggaa

SEQ ID NO: 6108 - DNA, 53 bp, Homo sapiens
agttctatttctatcccaaactaagctatgtgaaataagagaagctactttgt

SEQ ID NO: 6109 - DNA, 50 bp, Homo sapiens
atcccgatggtgcccaccgctattaaaggttcgtttgttccacgattaaa

SEQ ID NO: 6110 - DNA, 50 bp, Homo sapiens
atgtctccatacccattacaatctccagcattccccctcaaacctaaaaa

SEQ ID NO: 6111 - DNA, 50 bp, Homo sapiens
gcccgtatttaccctatagcaccccctctaccccctttagagcccaaaaa

SEQ ID NO: 6112 - DNA, 50 bp, Homo sapiens
acattttcctccgcataagcctgcgtcagattaaaacactgaactgacaa

SEQ ID NO: 6113 - DNA, 50 bp, Homo sapiens
ccaagctggtttcaagccaaccccatggcctccatgactttttccaaaac

SEQ ID NO: 6114 - DNA, 50 bp, Homo sapiens
tgatcaggtgaaccggaagtctccaatttctgaatggattatgtttctaa

SEQ ID NO: 6115 - DNA, 50 bp, Homo sapiens
tgagtacgtgacacttgttgtagaatagtggtgttgagctatattcttgt

SEQ ID NO: 6116 - DNA, 50 bp, Homo sapiens
gtgacccttggcacccgctagaagtttatggccgagctttaccaattaaa

SEQ ID NO: 6117 - DNA, 50 bp, Homo sapiens
tgaactccaactttgaccaacccatgagacccctgttatccaaactttct

SEQ ID NO: 6118 - DNA, 50 bp, Homo sapiens
ccctctactatttggctccataacttaggacctgcctttcccggttccag

SEQ ID NO: 6119 - DNA, 50 bp, Homo sapiens
cccgtatttaccctatagcaccccctctaccccctttagagccccaaaaa

SEQ ID NO: 6120 - DNA, 50 bp, Homo sapiens
ccaactttcagaacagaagggtgggaaaccagaaccgcctgccatgcccc

SEQ ID NO: 6121 - DNA, 50 bp, Homo sapiens
gcgccagaaatccaatccagcccaaggatatagttaggattaattactta

SEQ ID NO: 6122 - DNA, 50 bp, Homo sapiens
ctgagattttgggttttccacacgggccaagatacccggcctctgctgag

SEQ ID NO: 6123 - DNA, 50 bp, Homo sapiens
atatcatttccacttagtattatacccacacccacccaagaacagggttt

SEQ ID NO: 6124 - DNA, 50 bp, Homo sapiens
acagcatgagaaactgttagtacgcatacctcagttcaaacctttaggga

SEQ ID NO: 6125 - DNA, 50 bp, Homo sapiens
gcttgccctagcagagtcatacggaataatggaaaactcaacttctgttc

SEQ ID NO: 6126 - DNA, 50 bp, Homo sapiens
cacaatgctgcctcctctgtggatgactgatggcaagagtctgaattgaa

SEQ ID NO: 6127 - DNA, 50 bp, Homo sapiens
cctctcactctcagactccaagggccaagaaaaactacggacaggaagcc

SEQ ID NO: 6128 - DNA, 50 bp, Homo sapiens
gagaggaggggtctcagacgttgggggacacactgctgggtgggtgattt

SEQ ID NO: 6129 - DNA, 50 bp, Homo sapiens
taagaaatcccaattttcaggagtggtggtgtcaataaacgctctgtggc

SEQ ID NO: 6130 - DNA, 50 bp, Homo sapiens
cggcagggtggcctgtaacaatttcagttttcgcagaacattcaggtatt

SEQ ID NO: 6131 - DNA, 50 bp, Homo sapiens
ggggctcccttcccggctttgttttctctgggagattttattttacctaa

SEQ ID NO: 6132 - DNA, 50 bp, Homo sapiens
gaaagtggagggagtggacggggaggagactagccagagaggctcattag

SEQ ID NO: 6133 - DNA, 50 bp, Homo sapiens
cttctcccctcttgccctctgtggtctgatttaaaacgaaaaggtcggat

SEQ ID NO: 6134 - DNA, 50 bp, Homo sapiens
ggacttctgaaatagagctggctccctggggtgacaatgtatatatgcaa

SEQ ID NO: 6135 - DNA, 50 bp, Homo sapiens
ctgggtgtcgtggaagatgacgaagatgctgggctggcagatgcagtcca

SEQ ID NO: 6136 - DNA, 50 bp, Homo sapiens
accagggcttaaaacctcaatttatgttcatgacagtggggatttttctt

SEQ ID NO: 6137 - DNA, 50 bp, Homo sapiens
attctccaaccacaaacagcacttctaaaactaactttactttctgccca

SEQ ID NO: 6138 - DNA, 50 bp, Homo sapiens
gatatagtctccataccccattaccatctcccagccattccccctccaac

SEQ ID NO: 6139 - DNA, 50 bp, Homo sapiens
tgatactttggttctctttcctgctcaggtcccttcatttgtactttgga

SEQ ID NO: 6140 - DNA, 50 bp, Homo sapiens
taatactggaggggcttgaagaaggctgtcgtgttttgtcacctgctttg

SEQ ID NO: 6141 - DNA, 50 bp, Homo sapiens
gtctttcccgtctttcttcctcacctatgtaatttcagtagtctctcagc

SEQ ID NO: 6142 - DNA, 50 bp, Homo sapiens
aggaagagcctgcacctgtggtggaacaatcagggaaaaggaagtcaaaa

SEQ ID NO: 6143 - DNA, 50 bp, Homo sapiens
tttggagcttctataggagtggagaggggcagctcattgttgagagttgc

SEQ ID NO: 6144 - DNA, 50 bp, Homo sapiens
tgatctgactggaaaacaatcctgtatcccctcccaaagaatcatgggct

SEQ ID NO: 6145 - DNA, 50 bp, Homo sapiens
tcatcccttaaacactctgtgatgggatcttcaggatcatcttttgaagt

SEQ ID NO: 6146 - DNA, 50 bp, Homo sapiens
tgcgtttggtttaggaatgtgcttttgtacttccacttgaataaaggtgt

SEQ ID NO: 6147 - DNA, 50 bp, Homo sapiens
tgctcagggcacatgcacacagacatttatctctgcactcacattttgtg

SEQ ID NO: 6148 - DNA, 50 bp, Homo sapiens
ggttattgctgacacgctgtcctctggcgacctgtcgctggagaggttgg

SEQ ID NO: 6149 - DNA, 50 bp, Homo sapiens
cgttttctgagcatccgttgtgccttaacattttctgcttgtcctttggg

SEQ ID NO: 6150 - DNA, 50 bp, Homo sapiens
cttctgaatgcccgagtcttctcttttgtgctcacaaatgccacccaatc

SEQ ID NO: 6151 - DNA, 50 bp, Homo sapiens
tgcttacaagggtgattgaccttgccttactctttatgtaaattatggca

SEQ ID NO: 6152 - DNA, 50 bp, Homo sapiens
ctggcgtattaccattttgatagcctctcttcaggctagataagctgggg

SEQ ID NO: 6153 - DNA, 50 bp, Homo sapiens
ccctgtattattgaaatgtcagcataatgactggaaggtgaaattggtcc

SEQ ID NO: 6154 - DNA, 50 bp, Homo sapiens
actgctgttgcatgaatagatgatacaaagcaagtgatgaggttggtatg

SEQ ID NO: 6155 - DNA, 50 bp, Homo sapiens
tggaagaacaaattcagacatcatcagtaagtctttagggacacagggaa

SEQ ID NO: 6156 - DNA, 50 bp, Homo sapiens
agtgaaaactggtacagtgttctgcttgatttacaacatgtaacttgtga

SEQ ID NO: 6157 - DNA, 50 bp, Homo sapiens
gccagaaagtgtgggctgaagatggttggtttcatgtttttgtattatgt

SEQ ID NO: 6158 - DNA, 50 bp, Homo sapiens
tgtcctctgaacctgagtgaagaaatatactctgtcctttgtacctgcgt

SEQ ID NO: 6159 - DNA, 50 bp, Homo sapiens
ccatttccactacatgcctttcctaccttcccttcacaaccaatcaagtg

SEQ ID NO: 6160 - DNA, 50 bp, Homo sapiens
acacttccctgaatgttgaagaagatatgctatccatgcaatccttgtcg

SEQ ID NO: 6161 - DNA, 50 bp, Homo sapiens
acttgtgtttgaaccacttctgcttcctctttaacctgagatgcacacgt

SEQ ID NO: 6162 - DNA, 50 bp, Homo sapiens; identical to SEQ ID NO: 6062

SEQ ID NO: 6163 - DNA, 50 bp, Homo sapiens
tgacagaatgaactggaaatgaaatcccacagttatgatcgtagtagagt

SEQ ID NO: 6164 - DNA, 50 bp, Homo sapiens
aagtacagatgccatcccggtgctgtgatcttccagccattctccatttc

SEQ ID NO: 6165 - DNA, 50 bp, Homo sapiens
actgccaatctgatttaaaattctccaagcttaattctgtgcaacaaaca

SEQ ID NO: 6166 - DNA, 50 bp, Homo sapiens
gcctgttgttctgtttatcgccctattttacaaaactgattctgacctgg

SEQ ID NO: 6167 - DNA, 50 bp, Homo sapiens
aactggcattgctaagccccagaaaaatgtatttagtggaacagatgaaa

SEQ ID NO: 6168 - DNA, 50 bp, Homo sapiens
acactaggtccttttatacctgtgcctttacgttcgttttcctgattgca

SEQ ID NO: 6169 - DNA, 50 bp, Homo sapiens
aatacagattcattttatttaagcgtccgtggcaccgacagggaccccag

SEQ ID NO: 6170 - DNA, 50 bp, Homo sapiens
agttcatcccctttcagaagctgtttgctcttggctcattaaacctgtga

SEQ ID NO: 6171 - DNA, 50 bp, Homo sapiens
gcctcttttcctgtatcacacaagggtcagggatggtggagtaaaagctc

SEQ ID NO: 6172 - DNA, 50 bp, Homo sapiens
tgttaggtggcctctgcatacctatgggaactcagtgatgtaatgcaaag

SEQ ID NO: 6173 - DNA, 50 bp, Homo sapiens
ctggggccgtagcaaaaatcatgaaaaacacttcaacgtgtcctttcaat

SEQ ID NO: 6174 - DNA, 50 bp, Homo sapiens
tgccaagtcagcagatttgctttatgaattacagggactagaaatgccca

SEQ ID NO: 6175 - DNA, 50 bp, Homo sapiens
ttgcatgtctcttcctaaatttcattgtgttgatttctaatccttcccgt

SEQ ID NO: 6176 - DNA, 50 bp, Homo sapiens; identical to SEQ ID NO: 4273

SEQ ID NO: 6177 - DNA, 50 bp, Homo sapiens
gaagtgacactgactgtatctacctctccttttcttcatcaggtgttcct

SEQ ID NO: 6178 - DNA, 50 bp, Homo sapiens; identical to SEQ ID NO: 5021

SEQ ID NO: 6179 - DNA, 50 bp, Homo sapiens
aattccaaaggagtgatgttggaatagtccctctaagggagagaaatgca

SEQ ID NO: 6180 - DNA, 50 bp, Homo sapiens
agcccctccaccccacccagtacttttacaatgtgttattaaagacccct

SEQ ID NO: 6181 - DNA, 50 bp, Homo sapiens
ccatccttgagaaatgtgggcaccaagtccataatctccataaatccaat

SEQ ID NO: 6182 - DNA, 50 bp, Homo sapiens
cgttgcattttcacatttgtgtggcaggacaagcatggggcaagagggac

SEQ ID NO: 6183 - DNA, 50 bp, Homo sapiens
tatgagtttatgcgttttcccagccctccgaatcactgactggggcgttt

SEQ ID NO: 6184 - DNA, 50 bp, Homo sapiens
ttgaaaagatgacatcgccccaagagccaaaaataaatgggaattgaaaa

SEQ ID NO: 6185 - DNA, 50 bp, Homo sapiens; identical to SEQ ID NO: 4224

SEQ ID NO: 6186 - DNA, 50 bp, Homo sapiens
tggtgatatctgcttagatttccctgtatctttgctgccctccttcaagt

SEQ ID NO: 6187 - DNA, 50 bp, Homo sapiens
agttggagctatctgtgcagcagtttctctacagttgtgcataaatgttt

SEQ ID NO: 6188 - DNA, 50 bp, Homo sapiens
cgtgggaggatgacaaagaagcatgagtcaccctgctggataaacttaga

SEQ ID NO: 6189 - DNA, 50 bp, Homo sapiens
gtggtttggtcagcatacacacttctcatttcatttgatgtacacagcca

SEQ ID NO: 6190 - DNA, 50 bp, Homo sapiens
acctgggatttcatttctgctgaaagaaataggaagaacaggactcactt

SEQ ID NO: 6191 - DNA, 50 bp, Homo sapiens
gggtgtgatgaatagcgaatcatctcaaatccttgagcactcagtctagt

SEQ ID NO: 6192 - DNA, 50 bp, Homo sapiens
agctttcaccacctcgcagttgtagagatagtccccgaaatattattcca

SEQ ID NO: 6193 - DNA, 50 bp, Homo sapiens
gtgtgaagtgacagccttgtgtgtgatgttttctgccttccccaagtttg

SEQ ID NO: 6194 - DNA, 51 bp, Homo sapiens; identical to SEQ ID NO: 5427

SEQ ID NO: 6195 - DNA, 50 bp, Homo sapiens
taagtggattggcagactccttgttgcttaagagtggctttctaggcagg

SEQ ID NO: 6196 - DNA, 51 bp, Homo sapiens; identical to SEQ ID NO: 5427

SEQ ID NO: 6197 - DNA, 50 bp, Homo sapiens; identical to SEQ ID NO: 5944

SEQ ID NO: 6198 - DNA, 50 bp, Homo sapiens; identical to SEQ ID NO: 6141

SEQ ID NO: 6199 - DNA, 50 bp, Homo sapiens
ggtccactctcactctttctctgctgttgcaaatacatggataacaccgt

SEQ ID NO: 6200 - DNA, 50 bp, Homo sapiens
cattcagtatttattgggaagacttgtcaagcaccatgataagtggtgga

SEQ ID NO: 6201 - DNA, 50 bp, Homo sapiens
agagggggaaggacttacatgacatcctactgggaatttgctagaaacca

SEQ ID NO: 6202 - DNA, 50 bp, Homo sapiens
ctggtgaagctgactccccaggtaaagagatatcagctctgcttcagact

SEQ ID NO: 6203 - DNA, 50 bp, Homo sapiens
ttgcttcttcctgctttatagagttcccgtaaaatacccttcaccctggc

SEQ ID NO: 6204 - DNA, 51 bp, Homo sapiens
tctgacctccgtgacgtttattaccagctgatgtcccgtacactgatttca

SEQ ID NO: 6205 - DNA, 50 bp, Homo sapiens
gggaagggtcagcaacgatttctcaccaaatcactacacagacacaaagg

SEQ ID NO: 6206 - DNA, 50 bp, Homo sapiens
accactaaatggttacactacaccaagacactaaaatggcagggagccct

SEQ ID NO: 6207 - DNA, 50 bp, Homo sapiens
aaattcaaatcacccttgatacccacttctttctcccacccaaatctgat

SEQ ID NO: 6208 - DNA, 51 bp, Homo sapiens
accatatcgtgcaaaatgtaatatggaatttccaaacatcaatgaagggat

SEQ ID NO: 6209 - DNA, 50 bp, Homo sapiens
aataagtaccgtatataaacacttctctttctctcctccacaatggcacg

SEQ ID NO: 6210 - DNA, 50 bp, Homo sapiens
agcatcactcttagaagaagcaactccttcccttgattctgtgtatttgg

SEQ ID NO: 6211 - DNA, 53 bp, Homo sapiens
tcaacccagaatctataatgtatgaaataaattaatagagaacccaacagatc

SEQ ID NO: 6212 - DNA, 50 bp, Homo sapiens
aaggtctccatctaacaggtagagcagttggtgcagatgagatgagcctg

SEQ ID NO: 6213 - DNA, 50 bp, Homo sapiens
ggtgatgataccacctccaatgaacagggaagcaagttcatcagtcaaca

SEQ ID NO: 6214 - DNA, 50 bp, Homo sapiens
agctgttggggctgcactgagctgcaatttttaacatggatttataactt

SEQ ID NO: 6215 - DNA, 50 bp, Homo sapiens
aaggaatttgttttccctatcctaactcagtaacagagggtttactccga

SEQ ID NO: 6216 - DNA, 50 bp, Homo sapiens
cgcacacattttctgtatggacaaatcctggattggcttcgttatttggt

SEQ ID NO: 6217 - DNA, 50 bp, Homo sapiens
ggtaatgaaacaatcatccagttaacaatcagcaaggttcttcagagcct

SEQ ID NO: 6218 - DNA, 51 bp, Homo sapiens
tggaagagtggactgaagaaagaacttatactctccctcctctaaaattga

SEQ ID NO: 6219 - DNA, 50 bp, Homo sapiens
tcctgggctattggctttatgatatcttttgagaaacaggattttcactt

SEQ ID NO: 6220 - DNA, 50 bp, Homo sapiens
accttttaaggatgtcttatttccaccccaactctccactccattttagt

SEQ ID NO: 6221 - DNA, 50 bp, Homo sapiens
gaaccttcaaaactgtcactttgagttccagaagagtccttcagcatctt

SEQ ID NO: 6222 - DNA, 50 bp, Homo sapiens
gtatttgggcttctccaagcagatcacgcagacgacggtgctacatttga

SEQ ID NO: 6223 - DNA, 50 bp, Homo sapiens
caagcatactggttctttccaagctcactgttctcaccacacggccccac

SEQ ID NO: 6224 - DNA, 50 bp, Homo sapiens
tccatatccatttctgacgttgaaccatttgacagtgccaaggactttgg

SEQ ID NO: 6225 - DNA, 50 bp, Homo sapiens
aagcctgtttttcactctaaaaattcaagaggacacgctaagaacgatca

SEQ ID NO: 6226 - DNA, 50 bp, Homo sapiens; identical to SEQ ID NO: 4276

SEQ ID NO: 6227 - DNA, 50 bp, Homo sapiens
gcgcacatggctattttgatacacaaagttgtgtttgctactttagaagc

SEQ ID NO: 6228 - DNA, 50 bp, Homo sapiens
aactcacgacaattgctacaaaacaccagggaggggctttttgtgttttt

SEQ ID NO: 6229 - DNA, 50 bp, Homo sapiens; identical to SEQ ID NO: 6141

SEQ ID NO: 6230 - DNA, 50 bp, Homo sapiens
gccctggtatgtatgcctttctctcctactgtctaatagcacctcgtaaa

SEQ ID NO: 6231 - DNA, 50 bp, Homo sapiens
aagaaaccgtggaagatactggtttatttcaaatgagcagagtatgttgt

SEQ ID NO: 6232 - DNA, 50 bp, Homo sapiens
ccacctcttctgacatgaatgtagcataagttagcaatcggttcttccaa

SEQ ID NO: 6233 - DNA, 50 bp, Homo sapiens
aggttccctttcaaataaagataaagaatttgacttgggacactgccaga

SEQ ID NO: 6234 - DNA, 50 bp, Homo sapiens
ggctggcctcattttgaaaagttagtacaattttcttcagtgctaacttg

SEQ ID NO: 6235 - DNA, 50 bp, Homo sapiens
actccagaacgtcagaaatggtgtagcagaatgaattctgttataaggaa

SEQ ID NO: 6236 - DNA, 50 bp, Homo sapiens
ctgttcgaaagttggagactgcctgtacccaggttgatagtcaattgttt

SEQ ID NO: 6237 - DNA, 50 bp, Homo sapiens
ccaccttgagcgccttcttctggttggttgtcatgcagttctcacacatg

SEQ ID NO: 6238 - DNA, 50 bp, Homo sapiens
acccttcccctttttcatatcctttcttcaaaaatctaaatgatgtgcct

SEQ ID NO: 6239 - DNA, 50 bp, Homo sapiens
agttccaggaggtggttttaaatattggatgaaaacttacaggctgtttt

SEQ ID NO: 6240 - DNA, 50 bp, Homo sapiens
acaatacatttacaaagccatctttacatgcattaaacgagggctacaac

SEQ ID NO: 6241 - DNA, 50 bp, Homo sapiens; identical to SEQ ID NO: 6240

SEQ ID NO: 6242 - DNA, 50 bp, Homo sapiens
ggcctgaagaaggagataagtgttccattcggcaacataagagaagttaa

SEQ ID NO: 6243 - DNA, 50 bp, Homo sapiens
tccatcccaaaggagagctactgtactgactgtacttgtggaatgcagcg

SEQ ID NO: 6244 - DNA, 50 bp, Homo sapiens
acccaccactctcaggaccacctgaaggcagaataaaccggatcctgttg

SEQ ID NO: 6245 - DNA, 50 bp, Homo sapiens
aaattgtgtgagaaggctgataaacgtctgtggtttctccctgtgctatt

SEQ ID NO: 6246 - DNA, 51 bp, Homo sapiens
gctgggcttctgcaaaattataaagttgctttattaaattcatacatgcgg

SEQ ID NO: 6247 - DNA, 51 bp, Homo sapiens
agctgattcattcattctatgtgtgccactaaataaagagattgagcaagt

SEQ ID NO: 6248 - DNA, 50 bp, Homo sapiens
cttgaagctgtgttggtggcctgtgaccttccaatgcaatctagactgtg

SEQ ID NO: 6249 - DNA, 50 bp, Homo sapiens
ctcatacacttctcagcctcagcacctaaccctcacacaacactccagta

SEQ ID NO: 6250 - DNA, 50 bp, Homo sapiens
tgagtattgttgtgggggcgggtatgtctgtatataaatctgtgcagcca

SEQ ID NO: 6251 - DNA, 50 bp, Homo sapiens; identical to SEQ ID NO: 4263

SEQ ID NO: 6252 - DNA, 50 bp, Homo sapiens; identical to SEQ ID NO: 4347

SEQ ID NO: 6253 - DNA, 50 bp, Homo sapiens; identical to SEQ ID NO: 4226

SEQ ID NO: 6254 - DNA, 50 bp, Homo sapiens; identical to SEQ ID NO: 4353

SEQ ID NO: 6255 - DNA, 50 bp, Homo sapiens
aggttgttatcaggtggcacaaattaaatccatcttgaagacttcacaca

SEQ ID NO: 6256 - DNA, 50 bp, Homo sapiens; identical to SEQ ID NO: 5073

SEQ ID NO: 6257 - DNA, 50 bp, Homo sapiens
agagctatgggtgctacaggcttgtctttctaagtgacatattcttatct

SEQ ID NO: 6258 - DNA, 50 bp, Homo sapiens
acccttataaaccagagcccaggaaagacagctcgagtgtataattctct

SEQ ID NO: 6259 - DNA, 50 bp, Homo sapiens
agctcctccctctcaacacccagtttccttgggagttgtcattaaaggaa

SEQ ID NO: 6260 - DNA, 50 bp, Homo sapiens
gctgtaattctctgtctcatcatccttctcttttgtttccatagcctttt

SEQ ID NO: 6261 - DNA, 50 bp, Homo sapiens; identical to SEQ ID NO: 4227

SEQ ID NO: 6262 - DNA, 50 bp, Homo sapiens; identical to SEQ ID NO: 4306

SEQ ID NO: 6263 - DNA, 50 bp, Homo sapiens; identical to SEQ ID NO: 4322

SEQ ID NO: 6264 - DNA, 50 bp, Homo sapiens; identical to SEQ ID NO: 4208

SEQ ID NO: 6265 - DNA, 50 bp, Homo sapiens
agaggcaacacttaaacactagggctactgtggcatctatgtagacagga

SEQ ID NO: 6266 - DNA, 50 bp, Homo sapiens; identical to SEQ ID NO: 4296

SEQ ID NO: 6267 - DNA, 50 bp, Homo sapiens; identical to SEQ ID NO: 4274

SEQ ID NO: 6268 - DNA, 50 bp, Homo sapiens; identical to SEQ ID NO: 4273

SEQ ID NO: 6269 - DNA, 50 bp, Homo sapiens; identical to SEQ ID NO: 4250

SEQ ID NO: 6270 - DNA, 50 bp, Homo sapiens; identical to SEQ ID NO: 238

SEQ ID NO: 6271 - DNA, 50 bp, Homo sapiens; identical to SEQ ID NO: 4305

SEQ ID NO: 6272 - DNA, 50 bp, Homo sapiens
acttcccctttaggtatccctggagtaataatgacaacaaaattcactgc

SEQ ID NO: 6273 - DNA, 50 bp, Homo sapiens; identical to SEQ ID NO: 4205

SEQ ID NO: 6274 - DNA, 50 bp, Homo sapiens; identical to SEQ ID NO: 5148

SEQ ID NO: 6275 - DNA, 50 bp, Homo sapiens; identical to SEQ ID NO: 5170

SEQ ID NO: 6276 - DNA, 50 bp, Homo sapiens; identical to SEQ ID NO: 5189

SEQ ID NO: 6277 - DNA, 50 bp, Homo sapiens; identical to SEQ ID NO: 5215

SEQ ID NO: 6278 - DNA, 50 bp, Homo sapiens; identical to SEQ ID NO: 5262

SEQ ID NO: 6279 - DNA, 50 bp, Homo sapiens; identical to SEQ ID NO: 5269

SEQ ID NO: 6280 - DNA, 50 bp, Homo sapiens; identical to SEQ ID NO: 5328

SEQ ID NO: 6281 - DNA, 50 bp, Homo sapiens; identical to SEQ ID NO: 5341

SEQ ID NO: 6282 - DNA, 51 bp, Homo sapiens
gcaactgttttctaggacatgtttactagaactactttaagtatgctgtgc

SEQ ID NO: 6283 - DNA, 50 bp, Homo sapiens; identical to SEQ ID NO: 5350

SEQ ID NO: 6284 - DNA, 50 bp, Homo sapiens; identical to SEQ ID NO: 5357

SEQ ID NO: 6285 - DNA, 50 bp, Homo sapiens; identical to SEQ ID NO: 5359

SEQ ID NO: 6286 - DNA, 50 bp, Homo sapiens; identical to SEQ ID NO: 5363

SEQ ID NO: 6287 - DNA, 50 bp, Homo sapiens; identical to SEQ ID NO: 5366

SEQ ID NO: 6288 - DNA, 50 bp, Homo sapiens; identical to SEQ ID NO: 5368

SEQ ID NO: 6289 - DNA, 50 bp, Homo sapiens; identical to SEQ ID NO: 5379

SEQ ID NO: 6290 - DNA, 50 bp, Homo sapiens; identical to SEQ ID NO: 5388

SEQ ID NO: 6291 - DNA, 50 bp, Homo sapiens; identical to SEQ ID NO: 5422

SEQ ID NO: 6292 - DNA, 50 bp, Homo sapiens; identical to SEQ ID NO: 5446

SEQ ID NO: 6293 - DNA, 50 bp, Homo sapiens; identical to SEQ ID NO: 5447

SEQ ID NO: 6294 - DNA, 50 bp, Homo sapiens; identical to SEQ ID NO: 5454

SEQ ID NO: 6295 - DNA, 50 bp, Homo sapiens; identical to SEQ ID NO: 5494

SEQ ID NO: 6296 - DNA, 50 bp, Homo sapiens; identical to SEQ ID NO: 5496

SEQ ID NO: 6297 - DNA, 50 bp, Homo sapiens; identical to SEQ ID NO: 5501

SEQ ID NO: 6298 - DNA, 50 bp, Homo sapiens; identical to SEQ ID NO: 5508

SEQ ID NO: 6299 - DNA, 50 bp, Homo sapiens; identical to SEQ ID NO: 5517

SEQ ID NO: 6300 - DNA, 50 bp, Homo sapiens; identical to SEQ ID NO: 5519

SEQ ID NO: 6301 - DNA, 50 bp, Homo sapiens; identical to SEQ ID NO: 5522

SEQ ID NO: 6302 - DNA, 50 bp, Homo sapiens; identical to SEQ ID NO: 5525

SEQ ID NO: 6303 - DNA, 50 bp, Homo sapiens; identical to SEQ ID NO: 5527

SEQ ID NO: 6304 - DNA, 50 bp, Homo sapiens; identical to SEQ ID NO: 5540

SEQ ID NO: 6305 - DNA, 50 bp, Homo sapiens; identical to SEQ ID NO: 5542

SEQ ID NO: 6306 - DNA, 50 bp, Homo sapiens; identical to SEQ ID NO: 5543

SEQ ID NO: 6307 - DNA, 50 bp, Homo sapiens; identical to SEQ ID NO: 5552

SEQ ID NO: 6308 - DNA, 50 bp, Homo sapiens; identical to SEQ ID NO: 5559

SEQ ID NO: 6309 - DNA, 50 bp, Homo sapiens; identical to SEQ ID NO: 5571

SEQ ID NO: 6310 - DNA, 50 bp, Homo sapiens; identical to SEQ ID NO: 5682

SEQ ID NO: 6311 - DNA, 50 bp, Homo sapiens; identical to SEQ ID NO: 5712

SEQ ID NO: 6312 - DNA, 50 bp, Homo sapiens; identical to SEQ ID NO: 5714

SEQ ID NO: 6313 - DNA, 50 bp, Homo sapiens; identical to SEQ ID NO: 5723

SEQ ID NO: 6314 - DNA, 50 bp, Homo sapiens; identical to SEQ ID NO: 5725

SEQ ID NO: 6315 - DNA, 50 bp, Homo sapiens; identical to SEQ ID NO: 5775

SEQ ID NO: 6316 - DNA, 50 bp, Homo sapiens; identical to SEQ ID NO: 5938

SEQ ID NO: 6317 - DNA, 50 bp, Homo sapiens; identical to SEQ ID NO: 5944

SEQ ID NO: 6318 - DNA, 50 bp, Homo sapiens; identical to SEQ ID NO: 5953

SEQ ID NO: 6319 - DNA, 50 bp, Homo sapiens; identical to SEQ ID NO: 5954

SEQ ID NO: 6320 - DNA, 50 bp, Homo sapiens; identical to SEQ ID NO: 5959

SEQ ID NO: 6321 - DNA, 50 bp, Homo sapiens; identical to SEQ ID NO: 5961

SEQ ID NO: 6322 - DNA, 50 bp, Homo sapiens; identical to SEQ ID NO: 6002

SEQ ID NO: 6323 - DNA, 50 bp, Homo sapiens; identical to SEQ ID NO: 6010

SEQ ID NO: 6324 - DNA, 50 bp, Homo sapiens
tggcataatgttggattgaatctacattttggcagaagttaaacattccc

SEQ ID NO: 6325 - DNA, 50 bp, Homo sapiens; identical to SEQ ID NO: 6014

SEQ ID NO: 6326 - DNA, 50 bp, Homo sapiens; identical to SEQ ID NO: 6019

SEQ ID NO: 6327 - DNA, 50 bp, Homo sapiens; identical to SEQ ID NO: 6023

SEQ ID NO: 6328 - DNA, 50 bp, Homo sapiens; identical to SEQ ID NO: 6027

SEQ ID NO: 6329 - DNA, 50 bp, Homo sapiens; identical to SEQ ID NO: 6031

SEQ ID NO: 6330 - DNA, 50 bp, Homo sapiens; identical to SEQ ID NO: 6032

SEQ ID NO: 6331 - DNA, 50 bp, Homo sapiens; identical to SEQ ID NO: 4348

SEQ ID NO: 6332 - DNA, 50 bp, Homo sapiens; identical to SEQ ID NO: 6037

SEQ ID NO: 6333 - DNA, 50 bp, Homo sapiens; identical to SEQ ID NO: 6039

SEQ ID NO: 6334 - DNA, 50 bp, Homo sapiens; identical to SEQ ID NO: 6041

SEQ ID NO: 6335 - DNA, 50 bp, Homo sapiens; identical to SEQ ID NO: 6042

SEQ ID NO: 6336 - DNA, 50 bp, Homo sapiens; identical to SEQ ID NO: 6044

SEQ ID NO: 6337 - DNA, 50 bp, Homo sapiens; identical to SEQ ID NO: 6047

SEQ ID NO: 6338 - DNA, 50 bp, Homo sapiens; identical to SEQ ID NO: 6051

SEQ ID NO: 6339 - DNA, 50 bp, Homo sapiens; identical to SEQ ID NO: 6065

SEQ ID NO: 6340 - DNA, 50 bp, Homo sapiens; identical to SEQ ID NO: 6088

SEQ ID NO: 6341 - DNA, 50 bp, Homo sapiens; identical to SEQ ID NO: 6124

SEQ ID NO: 6342 - DNA, 50 bp, Homo sapiens; identical to SEQ ID NO: 6126

SEQ ID NO: 6343 - DNA, 50 bp, Homo sapiens; identical to SEQ ID NO: 6129

SEQ ID NO: 6344 - DNA, 50 bp, Homo sapiens; identical to SEQ ID NO: 6130

SEQ ID NO: 6345 - DNA, 50 bp, Homo sapiens
gctggagggagaggcactggggaatttttcctggtgaatactgaagttac

SEQ ID NO: 6346 - DNA, 50 bp, Homo sapiens; identical to SEQ ID NO: 6139

SEQ ID NO: 6347 - DNA, 50 bp, Homo sapiens
actgccagtgaagactgtaaagacagaacacactattttggagggaggat

SEQ ID NO: 6348 - DNA, 50 bp, Homo sapiens; identical to SEQ ID NO: 6142

SEQ ID NO: 6349 - DNA, 50 bp, Homo sapiens; identical to SEQ ID NO: 6143

SEQ ID NO: 6350 - DNA, 50 bp, Homo sapiens; identical to SEQ ID NO: 6144

SEQ ID NO: 6351 - DNA, 50 bp, Homo sapiens; identical to SEQ ID NO: 6149

SEQ ID NO: 6352 - DNA, 50 bp, Homo sapiens; identical to SEQ ID NO: 6154

SEQ ID NO: 6353 - DNA, 50 bp, Homo sapiens; identical to SEQ ID NO: 6156

SEQ ID NO: 6354 - DNA, 50 bp, Homo sapiens; identical to SEQ ID NO: 6158

SEQ ID NO: 6355 - DNA, 50 bp, Homo sapiens; identical to SEQ ID NO: 6159

SEQ ID NO: 6356 - DNA, 50 bp, Homo sapiens; identical to SEQ ID NO: 6169

SEQ ID NO: 6357 - DNA, 50 bp, Homo sapiens; identical to SEQ ID NO: 6171

SEQ ID NO: 6358 - DNA, 50 bp, Homo sapiens; identical to SEQ ID NO: 6173

SEQ ID NO: 6359 - DNA, 50 bp, Homo sapiens; identical to SEQ ID NO: 5309

SEQ ID NO: 6360 - DNA, 50 bp, Homo sapiens
aaggcaaccaaccacattagaagtcttggcactttgtaacggaacgggta

SEQ ID NO: 6361 - DNA, 50 bp, Homo sapiens; identical to SEQ ID NO: 6177

SEQ ID NO: 6362 - DNA, 50 bp, Homo sapiens; identical to SEQ ID NO: 6179

SEQ ID NO: 6363 - DNA, 50 bp, Homo sapiens; identical to SEQ ID NO: 6180

SEQ ID NO: 6364 - DNA, 50 bp, Homo sapiens; identical to SEQ ID NO: 6181

SEQ ID NO: 6365 - DNA, 50 bp, Homo sapiens; identical to SEQ ID NO: 6183

SEQ ID NO: 6366 - DNA, 50 bp, Homo sapiens; identical to SEQ ID NO: 6187

SEQ ID NO: 6367 - DNA, 50 bp, Homo sapiens; identical to SEQ ID NO: 6188

SEQ ID NO: 6368 - DNA, 50 bp, Homo sapiens; identical to SEQ ID NO: 6189

SEQ ID NO: 6369 - DNA, 50 bp, Homo sapiens; identical to SEQ ID NO: 6193

SEQ ID NO: 6370 - DNA, 50 bp, Homo sapiens; identical to SEQ ID NO: 6141

SEQ ID NO: 6371 - DNA, 50 bp, Homo sapiens; identical to SEQ ID NO: 1043

SEQ ID NO: 6372 - DNA, 50 bp, Homo sapiens
gtggaaatcagcacacaaccacaatgacatttaagcacaggatcattatt

SEQ ID NO: 6373 - DNA, 50 bp, Homo sapiens
agaatggcagacctgtttgctgaagtgttcataagataacaataggcttg

SEQ ID NO: 6374 - DNA, 50 bp, Homo sapiens
tgggattttgtttttaagtcatttggtttggggaggaccttgtttatttt

SEQ ID NO: 6375 - DNA, 50 bp, Homo sapiens
tggacaaactgacagggactgctttgaaagacaggtactcagttgagtat

SEQ ID NO: 6376 - DNA, 50 bp, Homo sapiens; identical to SEQ ID NO: 6225

SEQ ID NO: 6377 - DNA, 50 bp, Homo sapiens; identical to SEQ ID NO: 6233

SEQ ID NO: 6378 - DNA, 50 bp, Homo sapiens; identical to SEQ ID NO: 6236

SEQ ID NO: 6379 - DNA, 50 bp, Homo sapiens
agcagagttaagtttaaatttccattctcactagtttgtgacctttgcca

SEQ ID NO: 6380 - DNA, 50 bp, Homo sapiens; identical to SEQ ID NO: 6250

SEQ ID NO: 6381 - DNA, 50 bp, Homo sapiens
cccttgcagatacatgagacaggcaggggctggagtcttgttccatcctg

SEQ ID NO: 6382 - DNA, 50 bp, Homo sapiens
gagtagttgtctttcctggcactaacgttgagctcgtgtacgcactgaag

SEQ ID NO: 6383 - DNA, 50 bp, Homo sapiens
gagtccaatctacactctagtagtgaagacagaagagttggcatacgagt

SEQ ID NO: 6384 - DNA, 50 bp, Homo sapiens
ggctgaacttactcattaagccacataacttcgagtcaagttccagtcca

SEQ ID NO: 6385 - DNA, 50 bp, Homo sapiens
gctctcaagcctcctccaataaagctctatcgggaaacaaatgaaccagt

SEQ ID NO: 6386 - DNA, 50 bp, Homo sapiens
aggaatgcacacattgctccaggatcactgtgaggattaaaggagatggt

SEQ ID NO: 6387 - DNA, 50 bp, Homo sapiens
agtaacggaacagttcccagtactcctggttcctaggtgagcaggtgatg

SEQ ID NO: 6388 - DNA, 50 bp, Homo sapiens
ggtgtgaaccatgagaagttcgacaacagcctcaagatcatcagcaatga

SEQ ID NO: 6389 - DNA, 50 bp, Homo sapiens
ggaggtgtataggctgggatttgaaaaggaaaataatcagcgtggtgcca

SEQ ID NO: 6390 - DNA, 50 bp, Homo sapiens; identical to SEQ ID NO: 326

SEQ ID NO: 6391 - DNA, 50 bp, Homo sapiens
tccagcagatataggaagcagtgtatctaaacagacaaataaaaaggcct

SEQ ID NO: 6392 - DNA, 50 bp, Homo sapiens
atctagtgtacgagacttggagtcaggcagtgagactggtggggcacggg

SEQ ID NO: 6393 - DNA, 50 bp, Homo sapiens
tggtttaatggaaaatgctctggaaaattcttttgcaacagttcatcgct

SEQ ID NO: 6394 - DNA, 50 bp, Homo sapiens
cactaaaagagtggggaggtgcagcacctggctggggaacaagaatatgg

SEQ ID NO: 6395 - DNA, 50 bp, Homo sapiens
aaacgaatcacgtgcctcgaaagggacatatattgttcctttaagcattt

SEQ ID NO: 6396 - DNA, 50 bp, Homo sapiens
aagggttcaatttcttctttggaaggtgatggtaagggtgtggctccaga

SEQ ID NO: 6397 - DNA, 50 bp, Homo sapiens
tggacaattccaagtccaagaggactgtctactttcgaccttgtgtgatt

SEQ ID NO: 6398 - DNA, 50 bp, Homo sapiens
ttgtgttaacctgttgtccacgctaagatacaaacttcccggaggaaagt

SEQ ID NO: 6399 - DNA, 50 bp, Homo sapiens
tgtcacagtgttctattatttgcccggttcttaaagtgagagcatcctga

SEQ ID NO: 6400 - DNA, 50 bp, Homo sapiens
acaatgatattgatgaggcacccagtcttttcatttactctgagtgaagt

SEQ ID NO: 6401 - DNA, 50 bp, Homo sapiens; identical to SEQ ID NO: 3230

SEQ ID NO: 6402 - DNA, 50 bp, Homo sapiens
ggccagagaccctaagctgcttaatacatttataccacatccttctcagc

SEQ ID NO: 6403 - DNA, 50 bp, Homo sapiens
cccttggaattacttgttcaacttctttctttcccactagacggggactt

SEQ ID NO: 6404 - DNA, 50 bp, Homo sapiens
ctttgtagatgcagagagaagctataagaaaccccagtacttgccgggcg

SEQ ID NO: 6405 - DNA, 54 bp, Homo sapiens
actgccacatctgactttacagaataaccaatgtaagttaaaatagagaaacag

SEQ ID NO: 6406 - DNA, 50 bp, Homo sapiens
agtcttgcgagtcaactcagactcaaatgtagaactgggaaggacagtgc

SEQ ID NO: 6407 - DNA, 50 bp, Homo sapiens
agcactgtgcagatggctttagaagattcagaacagaagcacaatctgtt

SEQ ID NO: 6408 - DNA, 50 bp, Homo sapiens
agcactgtgcagatggctttggaagattcagaacagaagcacaatctgtt

SEQ ID NO: 6409 - DNA, 50 bp, Homo sapiens
ctatggagtcttggaggacactggagtcaccatgctaacactgtgcagat

SEQ ID NO: 6410 - DNA, 50 bp, Homo sapiens
ccctgtcacccttcgtggccagtgccagacagtaactagtggatgctaaa

SEQ ID NO: 6411 - DNA, 50 bp, Homo sapiens
gagagaatagggtagagagaccgggacttgggtagagatgaccgggattc

SEQ ID NO: 6412 - DNA, 50 bp, Homo sapiens
agtggaagctaggagaaatatcgaatgtgttagggactttgaagttacca

SEQ ID NO: 6413 - DNA, 50 bp, Homo sapiens
ctgcatctctctttactaccagtgattacaaagtggggtttggtgggagt

SEQ ID NO: 6414 - DNA, 50 bp, Homo sapiens
tctctgacttcttattaccaaggacactctatctgttgcctcttactctt

SEQ ID NO: 6415 - DNA, 50 bp, Homo sapiens
cagttcccagatgtgcgtgttgtggtccccaagtatcaccttccaatttc

SEQ ID NO: 6416 - DNA, 50 bp, Homo sapiens
aacgaccctgtattgcagaagattgtagacattctgtatgccacagatga

SEQ ID NO: 6417 - DNA, 50 bp, Homo sapiens
gggtcccgagcccttcaagagctagatttactcaagtttgttcccttgcc

SEQ ID NO: 6418 - DNA, 50 bp, Homo sapiens
cactgaagccaaaccacagaagacttttgagaatgaggagacaaatgagt

SEQ ID NO: 6419 - DNA, 50 bp, Homo sapiens
aggtgaaaattactcttcagaagatagcagagtggataatggcccatcga

SEQ ID NO: 6420 - DNA, 50 bp, Homo sapiens
tgcagtgagactacatttctgtctaaagaagatgtgtgagttccgtcctt

SEQ ID NO: 6421 - DNA, 50 bp, Homo sapiens
tccagccagccagctcatttcactttacaccctcatggactgggattata

SEQ ID NO: 6422 - DNA, 50 bp, Homo sapiens
tttcatacattggaactccacctgactttggaccaaccccagaacagagc

SEQ ID NO: 6423 - DNA, 50 bp, Homo sapiens
agcaccggaatacaaaaatgatactatgctgccctcctagatctcaggga

SEQ ID NO: 6424 - DNA, 50 bp, Homo sapiens
tgcccatacacatgagtatttgtctaaaacatgtcttctttgtagcagct

SEQ ID NO: 6425 - DNA, 50 bp, Homo sapiens
gcaaatctaaactgcaggaaaatttttgcacccgaagtattcagatccct

SEQ ID NO: 6426 - DNA, 50 bp, Homo sapiens
ggcccagtgctaatgtaaccaatgatgccatgtcgatattggaaaccata

SEQ ID NO: 6427 - DNA, 50 bp, Homo sapiens
ggggaagaacaagataatctagtgacctcaccacagtctatgcccaggcc

SEQ ID NO: 6428 - DNA, 50 bp, Homo sapiens
aattcaactgaaggcgaggaatgttggtgatgaagctgagatcaggactc

SEQ ID NO: 6429 - DNA, 50 bp, Homo sapiens
cacctatatcgaaagtttgggctcatctcccattggtggcaaagacctcc

SEQ ID NO: 6430 - DNA, 50 bp, Homo sapiens
tggtggaaaagtgtgtctgtctgacaattacactcaagtttacctctggt

SEQ ID NO: 6431 - DNA, 53 bp, Homo sapiens
acgataatactgttggttactgccataaatattggaagctaatgtaaaatgca

SEQ ID NO: 6432 - DNA, 50 bp, Homo sapiens
ttctcttataaaggacagcaagtttaaaatggagcaaggagcattggaaa

SEQ ID NO: 6433 - DNA, 50 bp, Homo sapiens
tggccaaagaatagaagctctagaccttccttatttctatcgtgaaaaca

SEQ ID NO: 6434 - DNA, 50 bp, Homo sapiens
acatgacctgtgcagtgtgtggctgtgaattctgttggctttgtatgaaa

SEQ ID NO: 6435 - DNA, 50 bp, Homo sapiens
tgacataactaccatccctgcaactaatgaacccaccctcacagcttcct

SEQ ID NO: 6436 - DNA, 50 bp, Homo sapiens
gaatgacataaaccccctccggtctgaggtccggccttccagcttgtctc

SEQ ID NO: 6437 - DNA, 50 bp, Homo sapiens
gcctttctcactccatccccacccaaagtgctcagaccttgtctagttat

SEQ ID NO: 6438 - DNA, 50 bp, Homo sapiens
tcgttttacaacgtcgtgactgggaaaaccctggcgttacccaacttaat

SEQ ID NO: 6439 - DNA, 50 bp, Homo sapiens
tgttttgttttctgaaacgaaatcctgctctgttggcccagctagaacgc

SEQ ID NO: 6440 - DNA, 50 bp, Homo sapiens
cagaagctggatgacgttgctccatcttcactctgttaatgagacatgat

SEQ ID NO: 6441 - DNA, 50 bp, Homo sapiens
cacatcttccattcagccctaccatgaaaaccgtacctcgggcgcgacca

SEQ ID NO: 6442 - DNA, 50 bp, Homo sapiens
aatttgctttaaattgagtttccttgccattgcacactcctatctttctg

SEQ ID NO: 6443 - DNA, 50 bp, Homo sapiens
cagatgacacgcgctctccaccacccaacccaaaccatgagaatttgcaa

SEQ ID NO: 6444 - DNA, 50 bp, Homo sapiens
cccatgctgttgattgctaaatgtaacagtctgatcgtgacgctgaataa

SEQ ID NO: 6445 - DNA, 50 bp, Homo sapiens
gacacagacagaccaagctatagtcagacctggttacacacatacacaca

SEQ ID NO: 6446 - DNA, 50 bp, Homo sapiens
tggcaaagatcactgaaatttaggacaccaaagctaaaaccccaaatgct

SEQ ID NO: 6447 - DNA, 50 bp, Homo sapiens
gcttgtgctcgagaccgcttgctatagaaacgctgagctgctggtttatg

SEQ ID NO: 6448 - DNA, 50 bp, Homo sapiens
ctggttaaaagccccattactgaccttcgccgccaccacgcctatcacta

SEQ ID NO: 6449 - DNA, 50 bp, Homo sapiens
gcatccacctccttctctgtctcatgtgtgctcttcttctttctacagta

SEQ ID NO: 6450 - DNA, 50 bp, Homo sapiens
ttaaatctatcaagaattcatccaaattggtaccctgccgggccgcctcg

SEQ ID NO: 6451 - DNA, 50 bp, Homo sapiens
agtgctgtattgactttgctcggcagtagatgaagctattctgaacccaa

SEQ ID NO: 6452 - DNA, 50 bp, Homo sapiens
tgctggacaaagacaatgagatgattattggtggtgggatggctgttacc

SEQ ID NO: 6453 - DNA, 50 bp, Homo sapiens
gtggaaaagtcactaccaggctggcagggaatggggcaatctattcatac

SEQ ID NO: 6454 - DNA, 50 bp, Homo sapiens
aagggacagggagcgggcacaaaataaaacttagtttggtagaaattata

SEQ ID NO: 6455 - DNA, 50 bp, Homo sapiens
tcaaagcactggagatgagagccaggatggacccgaaaagaattttacag

SEQ ID NO: 6456 - DNA, 56 bp, Homo sapiens
caggaacatggctgcagcatataaaaagaattgaattccatacttttgttaaccct

SEQ ID NO: 6457 - DNA, 50 bp, Homo sapiens
ttgccataaccacgcttgtagattagttcatttactgacttcagattggg

SEQ ID NO: 6458 - DNA, 50 bp, Homo sapiens
ttacaggcaaccggagcatccaatcacctttctctaagagagtacctcgg

SEQ ID NO: 6459 - DNA, 50 bp, Homo sapiens
aaaagcatcttcgagagggactgtcaattctcgactattttccaacccgc

SEQ ID NO: 6460 - DNA, 50 bp, Homo sapiens; identical to SEQ ID NO: 2020

SEQ ID NO: 6461 - DNA, 50 bp, Homo sapiens
agagacacctaaattacagatttgtgagctgagagctggagtttttcatt

SEQ ID NO: 6462 - DNA, 50 bp, Homo sapiens
aacagcaaagagagttacgaattacgttacttccagattaaccaggacga

SEQ ID NO: 6463 - DNA, 50 bp, Homo sapiens
agcgcaagatagatttggaataggaataagctctagttcttaacaaccga

SEQ ID NO: 6464 - DNA, 50 bp, Homo sapiens
gcatggacaagatgccaaggcccggatgctttaggatgaagttcttatct

SEQ ID NO: 6465 - DNA, 50 bp, Homo sapiens
cctccagtcaccatacacaggttaccagtgtcgaacttgatgaaatcagt

SEQ ID NO: 6466 - DNA, 50 bp, Homo sapiens
ccaaacatctggacttgtgactgtaaaaggggaggaggtagccaatgatt

SEQ ID NO: 6467 - DNA, 50 bp, Homo sapiens
ttatggtggtcggggtgggtggtagttcaatgggaggtatgggatttatt

SEQ ID NO: 6468 - DNA, 50 bp, Homo sapiens
agctgtctggctcaaagatctacattctgaagttggctggaaatgtcttg

SEQ ID NO: 6469 - DNA, 50 bp, Homo sapiens
ctggttcctaccagtgccagtgccttcagggcttcacaggccagtacctc

SEQ ID NO: 6470 - DNA, 50 bp, Homo sapiens
tgacacagactgtttcaatcttggagcagcgactgactttgacagaagat

SEQ ID NO: 6471 - DNA, 50 bp, Homo sapiens
tgctatttaaagcaccatgataaatatgaggccacttggaaatccatcca

SEQ ID NO: 6472 - DNA, 50 bp, Homo sapiens
gcaggcgatgctctataatctaaaatgtatctctctttccctaagctgaa

SEQ ID NO: 6473 - DNA, 50 bp, Homo sapiens
aagtaagaccacctgtgaacttgatcattatctggcgcacataggaagat

SEQ ID NO: 6474 - DNA, 50 bp, Homo sapiens
gctggggctgggaattgcgtgggctaatgtgtcatttgacttaagaaact

SEQ ID NO: 6475 - DNA, 50 bp, Homo sapiens
tttgggaagaaccgattgctaaattatgcctaattcatgtcagaagaggg

SEQ ID NO: 6476 - DNA, 50 bp, Homo sapiens
aagcagtataccatttatatagcaaacagccagtggccagttcactgtat

SEQ ID NO: 6477 - DNA, 50 bp, Homo sapiens
ctgccctttggtagtgagaggaccacgccaatgatgcttttaagtaacct

SEQ ID NO: 6478 - DNA, 50 bp, Homo sapiens
catttcttcatctctaaggcacacttgctacccctctttgctgaccccag

SEQ ID NO: 6479 - DNA, 50 bp, Homo sapiens
gcctgcgtgtctgtctcagtgtttcctggtcctcctctaagtactctaaa

SEQ ID NO: 6480 - DNA, 50 bp, Homo sapiens
aatcctagacatgtgcttgtcattgctcccatgaaggtagttttcaaaca

SEQ ID NO: 6481 - DNA, 50 bp, Homo sapiens
accaatagagaagaagctctagaagacaaaatcccaaaccttggcacaaa

SEQ ID NO: 6482 - DNA, 50 bp, Homo sapiens
ggcttcaacagaaacatcaaatgccaagaccagtgagagagcgtcaaaaa

SEQ ID NO: 6483 - DNA, 50 bp, Homo sapiens
gcaagcccactaaaataaacatctaaccagcatctttcccccattatagg

SEQ ID NO: 6484 - DNA, 50 bp, Homo sapiens
atggatctgttcctctgtgctaaatgtcttgtggcagggtgtgtttgtgg

SEQ ID NO: 6485 - DNA, 50 bp, Homo sapiens
gccgtaatgtctcgggatctctaataatagaggaggtgagttgtggtgtc

SEQ ID NO: 6486 - DNA, 50 bp, Homo sapiens
aggcactcctcaaccagtgttcactgaattcaactgctgaaattgtaaca

SEQ ID NO: 6487 - DNA, 50 bp, Homo sapiens
agagagggttttaagggagggcttgtgaatacttgggagaatacggaagg

SEQ ID NO: 6488 - DNA, 50 bp, Homo sapiens
atgaatttgaagacatggtggctgaaaagcggctcatcccagatggctgt

SEQ ID NO: 6489 - DNA, 50 bp, Homo sapiens
ttccacagataggtaagccaggcgcggcaagatgagactgtattcagtta

SEQ ID NO: 6490 - DNA, 50 bp, Homo sapiens
tcttgtcctagtcattgtggcaaccccatctgacaccttgtgtagtacct

SEQ ID NO: 6491 - DNA, 50 bp, Homo sapiens; identical to SEQ ID NO: 362

SEQ ID NO: 6492 - DNA, 50 bp, Homo sapiens
tttcaacatggctagatccatcagaaactgaaggcggggagaaagctctc

SEQ ID NO: 6493 - DNA, 50 bp, Homo sapiens
ggtactcaaaggaaattactctttctctggaaccctggcagaaagtttta

SEQ ID NO: 6494 - DNA, 50 bp, Homo sapiens
atccttcctaccttttattatgaaagttttggtacctggcccggcgagcg

SEQ ID NO: 6495 - DNA, 50 bp, Homo sapiens
attaaggtttttaacatctactttgggtgatggagccttcaatgaagtca

SEQ ID NO: 6496 - DNA, 50 bp, Homo sapiens
gaaagactacgaatttcgctgggaggtaatagggaagccttccacataaa

SEQ ID NO: 6497 - DNA, 50 bp, Homo sapiens
aaatgaggtcagcaataaccttgattcggtcctccactggcaacatttta

SEQ ID NO: 6498 - DNA, 50 bp, Homo sapiens
cttctctccctgtaaccaggcagtgtgtgggcggggctcagaacatatct

SEQ ID NO: 6499 - DNA, 50 bp, Homo sapiens
gttgccctgatctggaaatcctgttgcttcttctgggatgaaggaacctc

SEQ ID NO: 6500 - DNA, 50 bp, Homo sapiens
taagataacccacaggcacttcctgtcataaagccaacgacacagaccag

SEQ ID NO: 6501 - DNA, 50 bp, Homo sapiens
atgggaacaggatgttaaatacacacatacatacgcacacaagcgttggg

SEQ ID NO: 6502 - DNA, 50 bp, Homo sapiens
cctctgctatcactagagaatgtagagaatggaaatggctgcctttatgc

SEQ ID NO: 6503 - DNA, 50 bp, Homo sapiens
gatacagatgtgattattcagcctcaaggggacttctccattgcgtaacg

SEQ ID NO: 6504 - DNA, 50 bp, Homo sapiens
ttattgttaccaattagaatcagcaattcaactgtgcggtgatttggcct

SEQ ID NO: 6505 - DNA, 50 bp, Homo sapiens
tcatcacttgggttaactaaaggtttgcgtatcacacaattacactacaa

SEQ ID NO: 6506 - DNA, 50 bp, Homo sapiens
ttcatagtcaaacaaaaggtaagatcatgcatatacccacggcaacaagg

SEQ ID NO: 6507 - DNA, 50 bp, Homo sapiens
cccacccccttcccctccatgtgaagatttgggtgcttaacatatcattt

SEQ ID NO: 6508 - DNA, 50 bp, Homo sapiens
gggagacatgctgattccactcaaagatctcataataaacagctttggcc

SEQ ID NO: 6509 - DNA, 50 bp, Homo sapiens
aaataaatttggaatgggacattgtgctgtttcaccttcaatgctgttaa

SEQ ID NO: 6510 - DNA, 50 bp, Homo sapiens
agaacagtcttgggttcaggggtgtgatgccagaatgtattttcgtacct

SEQ ID NO: 6511 - DNA, 50 bp, Homo sapiens
aaggcgaagtcaatcccatctccctgaacccaactgccagtaggtagttc

SEQ ID NO: 6512 - DNA, 50 bp, Homo sapiens
agttaaactgttggtgaggtagtgtgtcaggtactctgtatattagctct

SEQ ID NO: 6513 - DNA, 50 bp, Homo sapiens
actggataaacagaacggatcaaagataaaagtattcttgttgcctgggc

SEQ ID NO: 6514 - DNA, 50 bp, Homo sapiens
gtcccttaggggagggagagttgtcctctttgcccacagtctaccctcag

SEQ ID NO: 6515 - DNA, 50 bp, Homo sapiens
actggactactgaactttagaatactgtcctaaggaaataggtctgggca

SEQ ID NO: 6516 - DNA, 50 bp, Homo sapiens
caaacaacaaaagtggcctccatcgctgtgagcctctcaagggacagggc

SEQ ID NO: 6517 - DNA, 50 bp, Homo sapiens
aaggtggctggcttttatgatacagtggtggtaatgtagccctttttggt

SEQ ID NO: 6518 - DNA, 50 bp, Homo sapiens
tgctcaattgccatacatgcactataggccgggatagaaaatcgtcagct

SEQ ID NO: 6519 - DNA, 50 bp, Homo sapiens
ttcaaggatgtgactgatatctggtgtggtttattttgtttgttttgggg

SEQ ID NO: 6520 - DNA, 50 bp, Homo sapiens
agctttggaaatttgaacaaggtggggacaaaatcaggcaataacagact

SEQ ID NO: 6521 - DNA, 50 bp, Homo sapiens
cacttcctgagtgtttcctgagaacaaaggatcagagcttcggctgtgag

SEQ ID NO: 6522 - DNA, 50 bp, Homo sapiens
ttttccttttcgctgactttcccactcactgtctgtctctcattttctct

SEQ ID NO: 6523 - DNA, 50 bp, Homo sapiens
gcatgggaattggctgtcatcactcatagcacggtgtataaactcaagga

SEQ ID NO: 6524 - DNA, 50 bp, Homo sapiens
gtccactcaagttacctggctgtctatcttttggctgacccctgaagcga

SEQ ID NO: 6525 - DNA, 50 bp, Homo sapiens
ctaagtaagcaaagaggcagaggggaggaggggagtgtttggtactgtcc

SEQ ID NO: 6526 - DNA, 50 bp, Homo sapiens
tggtgcggtgttcatgattattatgcagggtggaagttcagtatttggtc

SEQ ID NO: 6527 - DNA, 50 bp, Homo sapiens
agcacatttgtgcagaaaggttttgcaggtatctgaggcactgctcacct

SEQ ID NO: 6528 - DNA, 50 bp, Homo sapiens
agaacaacacgggattgaagtgggaagagatgggaccctcattggatctg

SEQ ID NO: 6529 - DNA, 50 bp, Homo sapiens
ggaacaatagacctcttcactagctccctgctgtttgatggtttggttgg

SEQ ID NO: 6530 - DNA, 50 bp, Homo sapiens
agaggatgactttgaggtaaatgtttacgatgcacggttttaggcgatgt

SEQ ID NO: 6531 - DNA, 50 bp, Homo sapiens
gtgtcctggggagtgaggagaggtggagtagactctgagaggagtgaaaa

SEQ ID NO: 6532 - DNA, 50 bp, Homo sapiens
agatcatgtctggattgtgtttcctattacctagagacgaacacagatct

SEQ ID NO: 6533 - DNA, 50 bp, Homo sapiens
gtgtcccaggacgagcgggagtgcaccatggacctctccgagttcatgaa

SEQ ID NO: 6534 - DNA, 50 bp, Homo sapiens
tgtatggcttatagccagagatgaaacagaacccaagttaatattgccag

SEQ ID NO: 6535 - DNA, 50 bp, Homo sapiens
aggtttcagaatctgggccttacctttacaggttcaacaaaagaatggca

SEQ ID NO: 6536 - DNA, 50 bp, Homo sapiens
aagatgaggcgtagctcatgtacaaatgcagcattctcataagtgcttta

SEQ ID NO: 6537 - DNA, 50 bp, Homo sapiens
agatagtggtatttgggtgctgggcttgtctgaactgaggaggtgggtgc

SEQ ID NO: 6538 - DNA, 50 bp, Homo sapiens
ccttgcaccagagacgactgacatatatagatgggagtcactcatgcgct

SEQ ID NO: 6539 - DNA, 50 bp, Homo sapiens
ggtgtagcgtgaagatctggacagcgcactacgacccgggccactgtttc

SEQ ID NO: 6540 - DNA, 50 bp, Homo sapiens
agaagcaaacctgtgaagctactatcgtttatcatcagtgtgaatgcact

SEQ ID NO: 6541 - DNA, 50 bp, Homo sapiens
tagtgatacaatttggggtgccagaggttgggggtaaggaattttgaagc

SEQ ID NO: 6542 - DNA, 50 bp, Homo sapiens
gtgtggcctaaggaacacctcttgtggggagtaagagccagcccttcctc

SEQ ID NO: 6543 - DNA, 50 bp, Homo sapiens
agatgcgggcgcaagcttatgtcctgttatgagggtttaaattagattgg

SEQ ID NO: 6544 - DNA, 50 bp, Homo sapiens
tcataacgcccttcaaaacattgaataaaatcagtgcaaaacattgagca

SEQ ID NO: 6545 - DNA, 50 bp, Homo sapiens
tgagaaaggagttagcagaatattaacataccgagaagctgttgttagca

SEQ ID NO: 6546 - DNA, 50 bp, Homo sapiens
ctggagactcaggtcgcttaagtggaggggacgggcacagccattcctcc

SEQ ID NO: 6547 - DNA, 50 bp, Homo sapiens
aaagacctgccacttatttttggctctcatctgtactcttaagtgtgtgt

SEQ ID NO: 6548 - DNA, 50 bp, Homo sapiens
agacacagctgcagaaaacttattcttttcaagcatgcacagtcacaaaa

SEQ ID NO: 6549 - DNA, 50 bp, Homo sapiens
cattcaacaacacaaaccgagcacctactgtgtgccacgccacagacaag

SEQ ID NO: 6550 - DNA, 50 bp, Homo sapiens
cctaggaaacacaggtcaaagaaacacagtccaacatgtattcagaattc

SEQ ID NO: 6551 - DNA, 50 bp, Homo sapiens
aaacgcaatctattttaggtttgagattagaagctgaggccaaggactca

SEQ ID NO: 6552 - DNA, 50 bp, Homo sapiens
tcctccagatgcatggtccgtgaagaaatttaatagcaaagacgagaaga

SEQ ID NO: 6553 - DNA, 50 bp, Homo sapiens
ggctctcatgcttatgccacacatccttgattctgcttaggagtctctgg

SEQ ID NO: 6554 - DNA, 50 bp, Homo sapiens
aagcctgagctaacaagagctgaggacagtagcttattcctctttatggg

SEQ ID NO: 6555 - DNA, 50 bp, Homo sapiens
tggatgatgggattggataagcatgtggactggattgtgttacaaactct

SEQ ID NO: 6556 - DNA, 50 bp, Homo sapiens
tgctgtttctaggattaacacgaaatcatcactttgccatattttgagct

SEQ ID NO: 6557 - DNA, 50 bp, Homo sapiens
ggctcagcacaaaagagaattcgtagcactttcatgtgaaagcagaccca

SEQ ID NO: 6558 - DNA, 50 bp, Homo sapiens
gatattaaggtactttcagtacaaatctggtgctgtgagtgggctcatcc

SEQ ID NO: 6559 - DNA, 50 bp, Homo sapiens
tccagtttctcataaacaaattcttctatcctggcatttggatttgggtt

SEQ ID NO: 6560 - DNA, 50 bp, Homo sapiens
tcatggtcatagctgtaacctgtgtgaaatagtaatcagatcaaaaagcg

SEQ ID NO: 6561 - DNA, 50 bp, Homo sapiens
atatgtacctggagggcggacgatcgaaattactagtgaattagcggcag

SEQ ID NO: 6562 - DNA, 50 bp, Homo sapiens
tgcgagtgtaatttctgtaaggagggtatgggataattaatagcacgcct

SEQ ID NO: 6563 - DNA, 50 bp, Homo sapiens
gcccccagcattcaattcattttgtacccttagtttaaagaacttctccc

SEQ ID NO: 6564 - DNA, 50 bp, Homo sapiens
aactttgctttctgaaggttttggtgtacctcgggcgcgaacacgctaat

SEQ ID NO: 6565 - DNA, 50 bp, Homo sapiens
attgactccactttgtgccaagctctgcgggtaggcatatttcatatctt

SEQ ID NO: 6566 - DNA, 50 bp, Homo sapiens
cagtggagaagctgcactgtctccgggcttgtgtgatccgatctctgtac

SEQ ID NO: 6567 - DNA, 50 bp, Homo sapiens
agctttgaaagtaatgtctaaccctgctgtcagtttatcacaagtgcatt

SEQ ID NO: 6568 - DNA, 50 bp, Homo sapiens
agcttaattgaattggaggagcaccgaacaggcagtttcctgagcagtgg

SEQ ID NO: 6569 - DNA, 50 bp, Homo sapiens
gctctcactgatctctcttctctatctctttctgcagttataccagcact

SEQ ID NO: 6570 - DNA, 50 bp, Homo sapiens
tgagaagagctgtgaaggcagaggcggggcaagtgcaaaggtcctgactt

SEQ ID NO: 6571 - DNA, 50 bp, Homo sapiens
aactccctgttcagttcagttgctaatgatctcaagctcttccctgatta

SEQ ID NO: 6572 - DNA, 50 bp, Homo sapiens
cagcctaatgcctaaccacacagataccattggtgggcgacgtgacccag

SEQ ID NO: 6573 - DNA, 50 bp, Homo sapiens
caccatcttttgctcggatactagcccgcaatacccactcacctaccacc

SEQ ID NO: 6574 - DNA, 50 bp, Homo sapiens
agggtctccaccttacagaagtacatgaacaaccagagatagcagggctg

SEQ ID NO: 6575 - DNA, 50 bp, Homo sapiens
accaggaaaagtaaaaatcatagttggtgtctctcgggtttctcaccttc

SEQ ID NO: 6576 - DNA, 50 bp, Homo sapiens
atgtatgagagagattcgagatgagttaaaggagggaagggaggggtggt

SEQ ID NO: 6577 - DNA, 50 bp, Homo sapiens
catgagtattggcactggggttcaagttccagggcagagcaggataagag

SEQ ID NO: 6578 - DNA, 50 bp, Homo sapiens
ctcctggggctggagtcctggtctgccttctggggacagagattaggtcg

SEQ ID NO: 6579 - DNA, 50 bp, Homo sapiens
tggaacttcagtcaaaaacatctgtactttgtacaggacaaagatttggc

SEQ ID NO: 6580 - DNA, 50 bp, Homo sapiens
atagaacttgttttacctatgagccttgccttgtatttattcactgtggc

SEQ ID NO: 6581 - DNA, 50 bp, Homo sapiens
acatctcttgtgaaagttcaaatgttacagcaaggtgtaaacactccact

SEQ ID NO: 6582 - DNA, 50 bp, Homo sapiens
gggtgaattaatcgggagatgggtagtcagggcaaatgatgggtgggttt

SEQ ID NO: 6583 - DNA, 50 bp, Homo sapiens
tgcaattgtggagacaaattgttagagtttaaatcctggctctgttccct

SEQ ID NO: 6584 - DNA, 50 bp, Homo sapiens
ggacctatgtcctcaagacatggaaactactagttctgtcgtgccaggag

SEQ ID NO: 6585 - DNA, 50 bp, Homo sapiens
aattaaggatgccctaccgacatctatcagcatacctggaacaggttcga

SEQ ID NO: 6586 - DNA, 50 bp, Homo sapiens
cggccaacccaggagggcaggtgttttgggcatctggtttatagtacctc

SEQ ID NO: 6587 - DNA, 50 bp, Homo sapiens
gctggggtgaaaacttgaagactcagacctcagtggaaacagatgaatgt

SEQ ID NO: 6588 - DNA, 50 bp, Homo sapiens
ccccaggctctgtgacgcttgaaattctaattagcgcagaaaagggctaa

SEQ ID NO: 6589 - DNA, 50 bp, Homo sapiens
cctgactacgtgttttccccacagacatcacactggttcacctcgttgaa

SEQ ID NO: 6590 - DNA, 53 bp, Homo sapiens
aatggaaagacacttctgtatacactggaaatctcaggaaatttcttttttcc

SEQ ID NO: 6591 - DNA, 50 bp, Homo sapiens
gacagtacagtaccctaagagcactgaggagggccaccccacgtgaactc

SEQ ID NO: 6592 - DNA, 50 bp, Homo sapiens
tttccttggagatttcaggcatcttaggccggaagggacctcgaaggtgg

SEQ ID NO: 6593 - DNA, 50 bp, Homo sapiens
ctccgcttctttcactcattcgtttagtgtttctttaagctttgccttgt

SEQ ID NO: 6594 - DNA, 50 bp, Homo sapiens
tccacattttgatcatgcatttatgaaagccctgggtttgttattgagaa

SEQ ID NO: 6595 - DNA, 50 bp, Homo sapiens
gctatcttctgctgaatcagcgtaatgctgatatacaccctattttctgt

SEQ ID NO: 6596 - DNA, 50 bp, Homo sapiens
aaaagaaaagtttttcaacccagggaatttatagtgggtgtcagtcgaga

SEQ ID NO: 6597 - DNA, 50 bp, Homo sapiens
aggagacgatgtagggggaagtgtgttagattgtaatggaggggtttgga

SEQ ID NO: 6598 - DNA, 50 bp, Homo sapiens
gctctttcccagacccagccgccaggttctctgtagaagaaaataaatgc

SEQ ID NO: 6599 - DNA, 50 bp, Homo sapiens
aaggaggaatgggaatctcaagctcaagggcactctcactaattgtgggt

SEQ ID NO: 6600 - DNA, 50 bp, Homo sapiens
aaatagccaccttctccccattttctgtcagaacacacactttatatcca

SEQ ID NO: 6601 - DNA, 50 bp, Homo sapiens
tttggtaaaagagattggaggggacaccagggaaaccaggattttctggc

SEQ ID NO: 6602 - DNA, 50 bp, Homo sapiens
aagtgctaaggcattctctaaactatctttccagctccgggcgacaatgg

SEQ ID NO: 6603 - DNA, 50 bp, Homo sapiens
ccactctctaagtcaagcgagtccttcctgcatacctgtactgggtgctg

SEQ ID NO: 6604 - DNA, 50 bp, Homo sapiens
ggactttgcaggcttcattccctgtctgtgtcttttccttctggtgtgtt

SEQ ID NO: 6605 - DNA, 50 bp, Homo sapiens
atttgctggccaatcctgctgactatgaatctttgggggcactgagttac

SEQ ID NO: 6606 - DNA, 50 bp, Homo sapiens
ctggggtactggggaaaaggaactggtattgagattttatatttggggcg

SEQ ID NO: 6607 - DNA, 50 bp, Homo sapiens
ttgagtaaggctcagagttgcagatgaggtgcagagaacatcctgtgact

SEQ ID NO: 6608 - DNA, 50 bp, Homo sapiens
ggtcacagagagaaatggtagctgaagaagcagggcacgagggctctaac

SEQ ID NO: 6609 - DNA, 50 bp, Homo sapiens
tttccggtatattcgtgtgggttgactttttgtgtgtgtggttgtggtgg

SEQ ID NO: 6610 - DNA, 50 bp, Homo sapiens
ggatctcttgctcctctcacctgtgtgacagactactaacagcccaactg

SEQ ID NO: 6611 - DNA, 50 bp, Homo sapiens
acagtgtgggacagaagagtgctcagtgattaaatgcctgataatagatt

SEQ ID NO: 6612 - DNA, 50 bp, Homo sapiens
ctctctcgcaatttacaaccgctttcagtaccattcaccgtcactcctct

SEQ ID NO: 6613 - DNA, 50 bp, Homo sapiens
ctttggggagtggagttgttgtagatggggagagaatcagaacaaggaga

SEQ ID NO: 6614 - DNA, 50 bp, Homo sapiens
ccttactgcttacggtcatcggtcatcagcccaacccgcttggttaggtg

SEQ ID NO: 6615 - DNA, 50 bp, Homo sapiens
agagtataatttccccagtgtggagtggttagtgttgctaaagaagaggt

SEQ ID NO: 6616 - DNA, 50 bp, Homo sapiens
ctgatgtcgtgtctgcactcacctggtcatgtgttctgttgtgcggtagt

SEQ ID NO: 6617 - DNA, 50 bp, Homo sapiens
aggggcagagaagaatccacactcacaagagatgaccaggagtaaaactg

SEQ ID NO: 6618 - DNA, 50 bp, Homo sapiens
cccagcagaggccaacaagcagccatacccaaacttcagccaaaataaaa

SEQ ID NO: 6619 - DNA, 50 bp, Homo sapiens
tgtgcaaatacggcgagaagaagtgcatgagaaagtgctttataagctgt

SEQ ID NO: 6620 - DNA, 50 bp, Homo sapiens
ccagcttttcctttgatgttagttagcagtaagtcacaggtttgagcccc

SEQ ID NO: 6621 - DNA, 50 bp, Homo sapiens
ggcacgcatcctcattcctgcatgctcttagaatatctatcaatgatcat

SEQ ID NO: 6622 - DNA, 50 bp, Homo sapiens
acttctatactcagtgcgctgtgggtaaccaagcaagcaggtttgttgtc

SEQ ID NO: 6623 - DNA, 50 bp, Homo sapiens
gcgggatggtgggaagacagacactgccttagagcatgaataattgaaga

SEQ ID NO: 6624 - DNA, 52 bp, Homo sapiens
aggtagactatttagctggaagcatccaaacaggggattttaaaaatactca

SEQ ID NO: 6625 - DNA, 52 bp, Homo sapiens
aaaatgtaggttaaaactctcacttaagaaggagaagatctgagtaaaccca

SEQ ID NO: 6626 - DNA, 50 bp, Homo sapiens
acctgaacaatgaatgaagaaaggaagacttggttcttctagctctggac

SEQ ID NO: 6627 - DNA, 50 bp, Homo sapiens
catggctcacaagctctaacactcccctccctccagatcctaagaagaag

SEQ ID NO: 6628 - DNA, 50 bp, Homo sapiens
tctgagcttcacttcaagaactggtagtccaaaagaactggttcgttcag

SEQ ID NO: 6629 - DNA, 50 bp, Homo sapiens
acttcactcactttttagcctgttcatatgagcttgtcagtgcttttgtt

SEQ ID NO: 6630 - DNA, 50 bp, Homo sapiens
tgaggaggatgggaggcgcacaggcaatttagctagatatagaaagagaa

SEQ ID NO: 6631 - DNA, 50 bp, Homo sapiens
agctgatttggattcttgcggtttgcatcggtctaatttatcaagtgtgt

SEQ ID NO: 6632 - DNA, 50 bp, Homo sapiens
tccatccttggaagcttgacaagcattcacactactggctcacctactat

SEQ ID NO: 6633 - DNA, 50 bp, Homo sapiens
tagcactgtagccagagtccctgcttgtaccaggaagctgggtggtggtt

SEQ ID NO: 6634 - DNA, 50 bp, Homo sapiens
tggatagtcagaattacgtgttttgtggattggggagggaggggaggaaa

SEQ ID NO: 6635 - DNA, 50 bp, Homo sapiens
gcactcctggaaccttctcactaattcggggaccagttttgtgaatgttg

SEQ ID NO: 6636 - DNA, 50 bp, Homo sapiens
ttgctgcggatgacctgactgagccctgggagactgtgctataatctctc

SEQ ID NO: 6637 - DNA, 50 bp, Homo sapiens
agaaggaggatctgttctaaacatctgcgaggggaggacaaagcattgaa

SEQ ID NO: 6638 - DNA, 50 bp, Homo sapiens
cttgcatctgagtgaagatgaacctttctttcccagccctgagagaggga

SEQ ID NO: 6639 - DNA, 50 bp, Homo sapiens
gtctagctggcaggtgatggatgaatggatgagctggcagaccaacagaa

SEQ ID NO: 6640 - DNA, 50 bp, Homo sapiens
tgcatggaaatgtttcgagtacggggaaaataagggagccaaaactgtgt

SEQ ID NO: 6641 - DNA, 50 bp, Homo sapiens
ttttaaggtgtgactcaatttacaggcattctgtatttttgcgatttggt

SEQ ID NO: 6642 - DNA, 50 bp, Homo sapiens
acctttgggagaaagtcttacaactacatgaaatgcagatttatggactc

SEQ ID NO: 6643 - DNA, 50 bp, Homo sapiens
gaagggacagaacaatcaactgtgagagatgggaagaaaactcaaatgga

SEQ ID NO: 6644 - DNA, 50 bp, Homo sapiens
ctagtttggggactttcattgggcacgtgaatccaggagggctgaatttt

SEQ ID NO: 6645 - DNA, 50 bp, Homo sapiens
ggcccagattgtagacagcataaaaataattttgggcttttcctgttaaa

SEQ ID NO: 6646 - DNA, 50 bp, Homo sapiens
ctgggcttcttgtgtgagaagcaccgcagccaagaacaaccagtgcaact

SEQ ID NO: 6647 - DNA, 50 bp, Homo sapiens
gaagggggattcggtgatgggggaagccaagggacaagggaaaaaggaaa

SEQ ID NO: 6648 - DNA, 50 bp, Homo sapiens
aacccaaccatgaaaaagaagaagctctggactacggccaggcgtgggag

SEQ ID NO: 6649 - DNA, 50 bp, Homo sapiens
tggctatttgagttttctcttacatgaaatgcctggcaacgtacactggc

SEQ ID NO: 6650 - DNA, 50 bp, Homo sapiens
tgaactctgatttccgccgaaactaggaggaaacacccaaaagaagacgg

SEQ ID NO: 6651 - DNA, 50 bp, Homo sapiens
tttgctgggactaaaatcaaaactgcactgcagagcaggtgagggttcat

SEQ ID NO: 6652 - DNA, 58 bp, Homo sapiens
tggagagtgtgtgtattaccatttttttacattgcatcacattttaccatctatatct

SEQ ID NO: 6653 - DNA, 50 bp, Homo sapiens
tttgaagcccctcatagagaagagactgtaccataagagaagcccactca

SEQ ID NO: 6654 - DNA, 50 bp, Homo sapiens
aactctcagtccatgagcttgattactccattgtaccatttggaagccca

SEQ ID NO: 6655 - DNA, 50 bp, Homo sapiens
gtgggtagccattaagtggtctggcacagaaagggacaagtagcttcaag

SEQ ID NO: 6656 - DNA, 50 bp, Homo sapiens
ctggtgctgagtggagtcacagtaaggctgtagatggagcgccctgggaa

SEQ ID NO: 6657 - DNA, 50 bp, Homo sapiens
ttttgatgtgaccagtcgtgcatggcgggggacaggagcttagggggaat

SEQ ID NO: 6658 - DNA, 50 bp, Homo sapiens
attatgcatgtcgaggggacaacttttattaaacaggaggggtgtgtctt

SEQ ID NO: 6659 - DNA, 50 bp, Homo sapiens
tggtcatgtttccctctttactccacgacagtttcattattgtaaccagg

SEQ ID NO: 6660 - DNA, 50 bp, Homo sapiens
ttctgttggttatatgaatggcagttattgtctcccagtgtgtgggttct

SEQ ID NO: 6661 - DNA, 50 bp, Homo sapiens
agtcctggcaactttacctgggaattgtctgtaatctttaagcagtggcg

SEQ ID NO: 6662 - DNA, 50 bp, Homo sapiens
aggacttatctagctttcacagattcagagtgcgtttcaaacatcattgt

SEQ ID NO: 6663 - DNA, 50 bp, Homo sapiens
tttaacaggcttatctaggacataggcccaagagggaggaggaggaaggc

SEQ ID NO: 6664 - DNA, 50 bp, Homo sapiens
ctccaggccgaacgagcctccactctggattaagatctgtcatcttgaca

SEQ ID NO: 6665 - DNA, 50 bp, Homo sapiens
gcaggacttgtggcaggactcaacgggagagaaagaggctgaaacataaa

SEQ ID NO: 6666 - DNA, 50 bp, Homo sapiens
aagaacatcccaacttttccggtaggcaagtgtcaagtcacctggacaat

SEQ ID NO: 6667 - DNA, 50 bp, Homo sapiens
tctgtggcttgttgtgggaccctgcgccctttaaattagggcatatttta

SEQ ID NO: 6668 - DNA, 50 bp, Homo sapiens
gcgctaaaaacctggtgattaaatgacaaacagaacgtgagaagagattt

SEQ ID NO: 6669 - DNA, 50 bp, Homo sapiens
tcctgcacacaacaaataaagacaagaataaagggccacccatcagtagc

SEQ ID NO: 6670 - DNA, 50 bp, Homo sapiens
atgttgttcaaattaaacatcataccacatgggggcagctaccaattttt

SEQ ID NO: 6671 - DNA, 50 bp, Homo sapiens
taatatgaaaagctggaaaagaattaaggggttgaggagacgtgccgggt

SEQ ID NO: 6672 - DNA, 50 bp, Homo sapiens
gttaccctgacgaatgcagtcctcgtgtggaatgtctatgccctcttgag

SEQ ID NO: 6673 - DNA, 50 bp, Homo sapiens
acaccagcagtcataggggaaaggggaatacagttaattgggtatttgtt

SEQ ID NO: 6674 - DNA, 50 bp, Homo sapiens
actccctcccatctctggtctttagttggaagcaagctttcggacaacgg

SEQ ID NO: 6675 - DNA, 50 bp, Homo sapiens
tccaacaagggttacggcagaatttatgcgaaagtcttctttgggctaaa

SEQ ID NO: 6676 - DNA, 50 bp, Homo sapiens
ttgttctgctcaggccaaggattgttgtgtgctctgtatttgctgctttg

SEQ ID NO: 6677 - DNA, 50 bp, Homo sapiens
ggcccggcatgtcttcgttttgtcagtcctcatccaatccatcttcatat

SEQ ID NO: 6678 - DNA, 50 bp, Homo sapiens
gtgggtttttagacacctgcagcaagaagaaatactgactgactaggcat

SEQ ID NO: 6679 - DNA, 50 bp, Homo sapiens
ttttaaagaaaaatctattatcttggagcatggatgggggaatgcgaagg

SEQ ID NO: 6680 - DNA, 50 bp, Homo sapiens
cagaagaaacatggcaaactgctctgtgctttcaaaccaaagtgttcccc

SEQ ID NO: 6681 - DNA, 50 bp, Homo sapiens
gttacttaagatcagtatgtgtggtgcatatgtgatttcgaccattcagt

SEQ ID NO: 6682 - DNA, 50 bp, Homo sapiens
gagaatttccgtctgatctatgacaccaagggtcgctttgctgtacctcg

SEQ ID NO: 6683 - DNA, 50 bp, Homo sapiens
ctgggttaatactcaccaactttgagaaggttggtctctgctcttctgta

SEQ ID NO: 6684 - DNA, 50 bp, Homo sapiens
ggaaagacaggtgagtgtgccacaactacctaacacatcagcaaatctgg

SEQ ID NO: 6685 - DNA, 50 bp, Homo sapiens; identical to SEQ ID NO: 378

SEQ ID NO: 6686 - DNA, 50 bp, Homo sapiens
cgataagctgtggtgttgggagtgagagatgttactttgcgaatgttcaa

SEQ ID NO: 6687 - DNA, 50 bp, Homo sapiens
aaaggctaggtttgcgaaagcccttctaaaactatgctttggtggttact

SEQ ID NO: 6688 - DNA, 50 bp, Homo sapiens
ctgaccctgccgggcggaagataaaacaaaaacgagaagaacaagcaaga

SEQ ID NO: 6689 - DNA, 50 bp, Homo sapiens
aagattgtaaaaatacattttaggctcaagagttccaggggtttcagagc

SEQ ID NO: 6690 - DNA, 50 bp, Homo sapiens
tgcaagctggcaccttcacgtttatttttaaagggcttcacatcaaagat

SEQ ID NO: 6691 - DNA, 50 bp, Homo sapiens
aaacaaagaaggaaaatgaagagggggaaaagatgaacatcaggctgggt

SEQ ID NO: 6692 - DNA, 50 bp, Homo sapiens
tccaaaggatgttctggtgttgcagcatgatttctggtgttagtctttct

SEQ ID NO: 6693 - DNA, 50 bp, Homo sapiens
tttgtgggtgcgtgagaggggatttatactccttgagccatattttgtga

SEQ ID NO: 6694 - DNA, 50 bp, Homo sapiens
gggttcacagcatgggtggaggtaagtagtattctcattggttggttagt

SEQ ID NO: 6695 - DNA, 50 bp, Homo sapiens
gacagtgagaagaatatggagtagagtccttttggtctttgaggcggtca

SEQ ID NO: 6696 - DNA, 50 bp, Homo sapiens
aacagctgaagaacaagaaggtgagctctgaatgcgtcaggtggtcattc

SEQ ID NO: 6697 - DNA, 50 bp, Homo sapiens
ggctgaccagtacaggcttgggaattttatggttgggtggtttctaccaa

SEQ ID NO: 6698 - DNA, 50 bp, Homo sapiens
gggggagctatattactgattaaaaccaccatttcttcacccaacttatg

SEQ ID NO: 6699 - DNA, 50 bp, Homo sapiens
aagtcttgtattatgaggtactggggctctgggggatattgagatgagaa

SEQ ID NO: 6700 - DNA, 50 bp, Homo sapiens; identical to SEQ ID NO: 382

SEQ ID NO: 6701 - DNA, 50 bp, Homo sapiens
ggagcttccagtctaatagaaaagatgcacttacgaatagactttgggta

SEQ ID NO: 6702 - DNA, 50 bp, Homo sapiens
tctgtgctctgtggacccgtcaccctgagctcctcagttgctgaaccatc

SEQ ID NO: 6703 - DNA, 50 bp, Homo sapiens
tgctggcatgtggatagactttagcaaatggtagtcatcttctaatttct

SEQ ID NO: 6704 - DNA, 50 bp, Homo sapiens
aatgggaatcttaaggcctctctggaaagggtgtgagggggtcgaggggg

SEQ ID NO: 6705 - DNA, 50 bp, Homo sapiens
tgcatattgtcactgactggctagggtctctaaatttatgaaaccttaca

SEQ ID NO: 6706 - DNA, 52 bp, Homo sapiens
gtcagcaactaaaaagggagatatatcttagagagactggaataagcaactc

SEQ ID NO: 6707 - DNA, 50 bp, Homo sapiens
ggaaggactcaaactggccataaaggcaatacggcatgttcattacacca

SEQ ID NO: 6708 - DNA, 50 bp, Homo sapiens
tttgttgactatgaaatagtggtcctggttttaactctttggggttccct

SEQ ID NO: 6709 - DNA, 50 bp, Homo sapiens
aattatattttaggctgatgtgggtggtctgtaatgctctcatttaccac

SEQ ID NO: 6710 - DNA, 50 bp, Homo sapiens
ctgtgtttctgtatggtattgcatttgtcccggcctgttgggtttggtgg

SEQ ID NO: 6711 - DNA, 50 bp, Homo sapiens
ttcatgctcattaggacattgaacaaatggcagagtaagaaagtttggcc

SEQ ID NO: 6712 - DNA, 50 bp, Homo sapiens
gggaatggactcatatgcaagattgctgacttcggattggcccgattgat

SEQ ID NO: 6713 - DNA, 50 bp, Homo sapiens
caacacatgggacgggaaggaaatccttccgtgtgattttgttaaaaata

SEQ ID NO: 6714 - DNA, 50 bp, Homo sapiens
cagccacctcctcaggtcagacaagcccagcacccaaataccactatctg

SEQ ID NO: 6715 - DNA, 50 bp, Homo sapiens
ggcttccctattacctcccagcgaaattcgtagtctttctctatggagtt

SEQ ID NO: 6716 - DNA, 50 bp, Homo sapiens
tgctgatgtgttaggtagttgtggcacactcacctgtctttcctaaatgc

SEQ ID NO: 6717 - DNA, 50 bp, Homo sapiens
ttcatgctcagcaaaacaacgttttaggatggtgagagaagacaaagtaa

SEQ ID NO: 6718 - DNA, 50 bp, Homo sapiens
tattaaccactcacgggagctctccatgcatttggtattttcgtctgggg

SEQ ID NO: 6719 - DNA, 50 bp, Homo sapiens
ttacctgctttgcatgctctccatcgtcaaagtcttctggaaacttaggc

SEQ ID NO: 6720 - DNA, 50 bp, Homo sapiens
ccccaccccaacacatacaaacgtttcccaccaatccttgaactgcaaaa

SEQ ID NO: 6721 - DNA, 50 bp, Homo sapiens
ttcaaggtcccaatacccaactaactcgaaggaagaaatggaaatctatt

SEQ ID NO: 6722 - DNA, 50 bp, Homo sapiens
tgcacagaactcttacttacatgtctcatcgaaactccagaacaccgtcg

SEQ ID NO: 6723 - DNA, 50 bp, Homo sapiens
tgcatgtatcccggtaattcaaatccaatttcacagccactgctgaatat

SEQ ID NO: 6724 - DNA, 50 bp, Homo sapiens
tacaggaaaatgaaactagacgggtgggggacactagaatgaaaaccagt

SEQ ID NO: 6725 - DNA, 50 bp, Homo sapiens
agtttctgctttcagtgactgaggctttgctttaacctggtgactcccaa

SEQ ID NO: 6726 - DNA, 50 bp, Homo sapiens
tcccacttcaagttaagcaccaaagcaatcactaattctggagcacagga

SEQ ID NO: 6727 - DNA, 50 bp, Homo sapiens
catggatgggggcagtggtgtttctagtgtgtgaggaagcagagcagatg

SEQ ID NO: 6728 - DNA, 50 bp, Homo sapiens
tcaccacagatgggaagatcgtttcctgaaaacagtctataaatcacaga

SEQ ID NO: 6729 - DNA, 50 bp, Homo sapiens
cagacgctccagtgctgccgaggttagtgtgtttattagacctgaaatga

SEQ ID NO: 6730 - DNA, 50 bp, Homo sapiens
ccctttaggcctcttgcccgaacagtgaacactaatagatatcctaagct

SEQ ID NO: 6731 - DNA, 50 bp, Homo sapiens
atggggatcatgttttatttttctctatataatgggccagtgtgttccca

SEQ ID NO: 6732 - DNA, 50 bp, Homo sapiens
agctgtagaccataagccaccttcaggtagtggtttgggaaatcaagcaa

SEQ ID NO: 6733 - DNA, 50 bp, Homo sapiens
tgtacttatgcttgtcttctctacctgcccccagtcttgaagtggtggaa

SEQ ID NO: 6734 - DNA, 50 bp, Homo sapiens
ggagggtgtgggaagcaagagaagaacattctgttaggggcagagaagaa

SEQ ID NO: 6735 - DNA, 50 bp, Homo sapiens
gcatctccagctttcatagttacccaacttgtaaaccagaagatgtgctg

SEQ ID NO: 6736 - DNA, 50 bp, Homo sapiens
ggccagtgccagacggtagctagttggatgctaaaggtagaatttagata

SEQ ID NO: 6737 - DNA, 50 bp, Homo sapiens
ggcattgtaggttgacaccagcaaagactcagagtgacttgagcattgga

SEQ ID NO: 6738 - DNA, 50 bp, Homo sapiens
agcccatttggatatggcccatctttacctaatggctactatagtgaggt

SEQ ID NO: 6739 - DNA, 50 bp, Homo sapiens; identical to SEQ ID NO: 4953

SEQ ID NO: 6740 - DNA, 50 bp, Homo sapiens
aatggtcaggcacaggtagaatcaaagtcctgtatgtatgttcacacaga

SEQ ID NO: 6741 - DNA, 50 bp, Homo sapiens
tacctgaaggtgtagagagtgcccgcatccagcaaggccaacagctccac

SEQ ID NO: 6742 - DNA, 50 bp, Homo sapiens
ctgtgtttttcccaaagcaacaatttcaaacaaagtgagagccactgaca

SEQ ID NO: 6743 - DNA, 50 bp, Homo sapiens
gactccgagctcaagtcagtctgtacccccaacccctaacccactgcatc

SEQ ID NO: 6744 - DNA, 50 bp, Homo sapiens
tgtaactgactttatgtatcactcaagtcttgcctttactgagtgcctga

SEQ ID NO: 6745 - DNA, 50 bp, Homo sapiens
tctctctaaccaaaactgtaatcttcaggaccagcaaactcagcccaagg

SEQ ID NO: 6746 - DNA, 50 bp, Homo sapiens
aactcttggttaaatgggttaatagaggattggaacactttgtttgctgt

SEQ ID NO: 6747 - DNA, 50 bp, Homo sapiens; identical to SEQ ID NO: 6540

SEQ ID NO: 6748 - DNA, 50 bp, Homo sapiens
ggactaacttccacctcctctgctacttccagctgcttctaatcacactt

SEQ ID NO: 6749 - DNA, 50 bp, Homo sapiens
agtcttccacccagcataggtatcacacaaccagctctgttttactcctg

SEQ ID NO: 6750 - DNA, 50 bp, Homo sapiens
ttagctggtacattgttcagagtttactgggagccggtaagatagtcacc

SEQ ID NO: 6751 - DNA, 50 bp, Homo sapiens
agcgtgatgcttcctcatgtcggtgattttctgttgagacatcttcaagc

SEQ ID NO: 6752 - DNA, 56 bp, Homo sapiens
cagggttaacaaaagtatggaattcaattctttttatatgctgcagccatgttcct

SEQ ID NO: 6753 - DNA, 50 bp, Homo sapiens
tgtaattgatttccgcataaacggtcattactggcacctatggcagcacc

SEQ ID NO: 6754 - DNA, 50 bp, Homo sapiens
gtgatccacttggagctgctactggtcccattgagtcctatagtacttca

SEQ ID NO: 6755 - DNA, 50 bp, Homo sapiens
tgccatgaaatctctattaattctcagaaagatcaaaggaggtcccgtgt

SEQ ID NO: 6756 - DNA, 50 bp, Homo sapiens
cccacctggcaaatcctcaagtgtgaccctagtcatctttctccttttgg

SEQ ID NO: 6757 - DNA, 50 bp, Homo sapiens
gctaaacagaaaagaacctgaagtacagttcccgtcttcaaagaagatgc

SEQ ID NO: 6758 - DNA, 50 bp, Homo sapiens
atcctcctcccctgggatggcatagaagagactttaaaaccaaatgagcc

SEQ ID NO: 6759 - DNA, 50 bp, Homo sapiens
gtcagtaagctctgcctgccaagaagacacagtgagaggtgtccacagtc

SEQ ID NO: 6760 - DNA, 50 bp, Homo sapiens
gtttccacttagttacttcttcctacctgctgtgaagctctgcaccctgc

SEQ ID NO: 6761 - DNA, 50 bp, Homo sapiens
agagtaatccacatcccagggacagtcacaatgacctacggctttagctg

SEQ ID NO: 6762 - DNA, 50 bp, Homo sapiens
gcagggctacaccaagtccattgatatttggtctgtaggctgcattctgg

SEQ ID NO: 6763 - DNA, 50 bp, Homo sapiens
tcttctctaaaatgccctcctctccttcctttttccagacctggtttaaa

SEQ ID NO: 6764 - DNA, 50 bp, Homo sapiens
tcgccatttggtagttccacagtgactgctcttctattttacgaagccac

SEQ ID NO: 6765 - DNA, 50 bp, Homo sapiens
gtagattactatgagaccagcagcctctgctcccagccagctgtggtgtg

SEQ ID NO: 6766 - DNA, 50 bp, Homo sapiens
tttccttttcgctgactttctcactcactgtctgtctctcattttctcca

SEQ ID NO: 6767 - DNA, 50 bp, Homo sapiens
tggtaagtttctggcagtgtggagacaggggaataatctcaacagtaggt

SEQ ID NO: 6768 - DNA, 50 bp, Homo sapiens
ccatggtggtgcttgactttgctttggggcttaatcctagtatcatttgg

SEQ ID NO: 6769 - DNA, 50 bp, Homo sapiens
tcagtgggtgttggttgtccattagttgagacttagttgttgctctggga

SEQ ID NO: 6770 - DNA, 50 bp, Homo sapiens
ggctggacagcagatgattcaaatctcaatactacatgcccattctgtgg

SEQ ID NO: 6771 - DNA, 50 bp, Homo sapiens
caggatggaacaagactccagcccctgcctgtctcatgtatctgcaaggg

SEQ ID NO: 6772 - DNA, 50 bp, Homo sapiens
cttcagtgcgtacacgagctcaacgttagtgccaggaaagacaactactc

SEQ ID NO: 6773 - DNA, 50 bp, Homo sapiens
actcgtatgccaactcttctgtcttcactactagagtgtagattggactc

SEQ ID NO: 6774 - DNA, 50 bp, Homo sapiens
tggactggaacttgactcgaagttatgtggcttaatgagtaagttcagcc

SEQ ID NO: 6775 - DNA, 50 bp, Homo sapiens
actggttcatttgtttcccgatagagctttattggaggaggcttgagagc

SEQ ID NO: 6776 - DNA, 50 bp, Homo sapiens
accatctcctttaatcctcacagtgatcctggagcaatgtgtgcattcct

SEQ ID NO: 6777 - DNA, 50 bp, Homo sapiens
catcacctgctcacctaggaaccaggagtactgggaactgttccgttact

SEQ ID NO: 6778 - DNA, 50 bp, Homo sapiens
tcattgctgatgatcttgaggctgttgtcgaacttctcatggttcacacc

SEQ ID NO: 6779 - DNA, 50 bp, Homo sapiens
tggcaccacgctgattattttccttttcaaatcccagcctatacacctcc

SEQ ID NO: 6780 - DNA, 50 bp, Homo sapiens; identical to SEQ ID NO: 327

SEQ ID NO: 6781 - DNA, 50 bp, Homo sapiens
aggcctttttatttgtctgtttagatacactgcttcctatatctgctgga

SEQ ID NO: 6782 - DNA, 50 bp, Homo sapiens
cccgtgccccaccagtctcactgcctgactccaagtctcgtacactagat

SEQ ID NO: 6783 - DNA, 50 bp, Homo sapiens
agcgatgaactgttgcaaaagaattttccagagcattttccattaaacca

SEQ ID NO: 6784 - DNA, 50 bp, Homo sapiens
ccatattcttgttccccagccaggtgctgcacctccccactcttttagtg

SEQ ID NO: 6785 - DNA, 50 bp, Homo sapiens
aaatgcttaaaggaacaatatatgtccctttcgaggcacgtgattcgttt

SEQ ID NO: 6786 - DNA, 50 bp, Homo sapiens
tctggagccacacccttaccatcaccttccaaagaagaaattgaaccctt

SEQ ID NO: 6787 - DNA, 50 bp, Homo sapiens
aatcacacaaggtcgaaagtagacagtcctcttggacttggaattgtcca

SEQ ID NO: 6788 - DNA, 50 bp, Homo sapiens
actttcctccgggaagtttgtatcttagcgtggacaacaggttaacacaa

SEQ ID NO: 6789 - DNA, 50 bp, Homo sapiens
tcaggatgctctcactttaagaaccgggcaaataatagaacactgtgaca

SEQ ID NO: 6790 - DNA, 50 bp, Homo sapiens
acttcactcagagtaaatgaaaagactgggtgcctcatcaatatcattgt

SEQ ID NO: 6791 - DNA, 50 bp, Homo sapiens
tgactgaaggcaagctcacagatgaagcagaggactgaagatctcgatct

SEQ ID NO: 6792 - DNA, 50 bp, Homo sapiens
gctgagaaggatgtggtataaatgtattaagcagcttagggtctctggcc

SEQ ID NO: 6793 - DNA, 50 bp, Homo sapiens
aagtccccgtctagtgggaaagaaagaagttgaacaagtaattccaaggg

SEQ ID NO: 6794 - DNA, 50 bp, Homo sapiens
cgcccggcaagtactggggtttcttatagcttctctctgcatctacaaag

SEQ ID NO: 6795 - DNA, 54 bp, Homo sapiens
ctgtttctctattttaacttacattggttattctgtaaagtcagatgtggcagt

SEQ ID NO: 6796 - DNA, 50 bp, Homo sapiens
gcactgtccttcccagttctacatttgagtctgagttgactcgcaagact

SEQ ID NO: 6797 - DNA, 50 bp, Homo sapiens
aacagattgtgcttctgttctgaatcttctaaagccatctgcacagtgct

SEQ ID NO: 6798 - DNA, 50 bp, Homo sapiens
aacagattgtgcttctgttctgaatcttccaaagccatctgcacagtgct

SEQ ID NO: 6799 - DNA, 50 bp, Homo sapiens
atctgcacagtgttagcatggtgactccagtgtcctccaagactccatag

SEQ ID NO: 6800 - DNA, 50 bp, Homo sapiens
tttagcatccactagttactgtctggcactggccacgaagggtgacaggg

SEQ ID NO: 6801 - DNA, 50 bp, Homo sapiens
gaatcccggtcatctctacccaagtcccggtctctctaccctattctctc

SEQ ID NO: 6802 - DNA, 50 bp, Homo sapiens
tggtaacttcaaagtccctaacacattcgatatttctcctagcttccact

SEQ ID NO: 6803 - DNA, 50 bp, Homo sapiens
actcccaccaaaccccactttgtaatcactggtagtaaagagagatgcag

SEQ ID NO: 6804 - DNA, 50 bp, Homo sapiens
aagagtaagaggcaacagatagagtgtccttggtaataagaagtcagaga

SEQ ID NO: 6805 - DNA, 50 bp, Homo sapiens
gaaattggaaggtgatacttggggaccacaacacgcacatctgggaactg

SEQ ID NO: 6806 - DNA, 50 bp, Homo sapiens
tcatctgtggcatacagaatgtctacaatcttctgcaatacagggtcgtt

SEQ ID NO: 6807 - DNA, 50 bp, Homo sapiens
ggcaagggaacaaacttgagtaaatctagctcttgaagggctcgggaccc

SEQ ID NO: 6808 - DNA, 50 bp, Homo sapiens
actcatttgtctcctcattctcaaaagtcttctgtggtttggcttcagtg

SEQ ID NO: 6809 - DNA, 50 bp, Homo sapiens
tcgatgggccattatccactctgctatcttctgaagagtaattttcacct

SEQ ID NO: 6810 - DNA, 50 bp, Homo sapiens
aaggacggaactcacacatcttctttagacagaaatgtagtctcactgca

SEQ ID NO: 6811 - DNA, 50 bp, Homo sapiens
tataatcccagtccatgagggtgtaaagtgaaatgagctggctggctgga

SEQ ID NO: 6812 - DNA, 50 bp, Homo sapiens
gctctgttctggggttggtccaaagtcaggtggagttccaatgtatgaaa

SEQ ID NO: 6813 - DNA, 50 bp, Homo sapiens
tccctgagatctaggagggcagcatagtatcatttttgtattccggtgct

SEQ ID NO: 6814 - DNA, 50 bp, Homo sapiens
agctgctacaaagaagacatgttttagacaaatactcatgtgtatgggca

SEQ ID NO: 6815 - DNA, 50 bp, Homo sapiens
agggatctgaatacttcgggtgcaaaaattttcctgcagtttagatttgc

SEQ ID NO: 6816 - DNA, 50 bp, Homo sapiens
tatggtttccaatatcgacatggcatcattggttacattagcactgggcc

SEQ ID NO: 6817 - DNA, 50 bp, Homo sapiens
ggcctgggcatagactgtggtgaggtcactagattatcttgttcttcccc

SEQ ID NO: 6818 - DNA, 50 bp, Homo sapiens
gagtcctgatctcagcttcatcaccaacattcctcgccttcagttgaatt

SEQ ID NO: 6819 - DNA, 50 bp, Homo sapiens
ggaggtctttgccaccaatgggagatgagcccaaactttcgatataggtg

SEQ ID NO: 6820 - DNA, 50 bp, Homo sapiens
accagaggtaaacttgagtgtaattgtcagacagacacacttttccacca

SEQ ID NO: 6821 - DNA, 53 bp, Homo sapiens
tgcattttacattagcttccaatatttatggcagtaaccaacagtattatcgt

SEQ ID NO: 6822 - DNA, 50 bp, Homo sapiens
tttccaatgctccttgctccattttaaacttgctgtcctttataagagaa

SEQ ID NO: 6823 - DNA, 50 bp, Homo sapiens
tgttttcacgatagaaataaggaaggtctagagcttctattctttggcca

SEQ ID NO: 6824 - DNA, 50 bp, Homo sapiens
tttcatacaaagccaacagaattcacagccacacactgcacaggtcatgt

SEQ ID NO: 6825 - DNA, 50 bp, Homo sapiens
aggaagctgtgagggtgggttcattagttgcagggatggtagttatgtca

SEQ ID NO: 6826 - DNA, 50 bp, Homo sapiens
gagacaagctggaaggccggacctcagaccggagggggtttatgtcattc

SEQ ID NO: 6827 - DNA, 50 bp, Homo sapiens
ataactagacaaggtctgagcactttgggtggggatggagtgagaaaggc

SEQ ID NO: 6828 - DNA, 50 bp, Homo sapiens
attaagttgggtaacgccagggttttcccagtcacgacgttgtaaaacga

SEQ ID NO: 6829 - DNA, 50 bp, Homo sapiens
gcgttctagctgggccaacagagcaggatttcgtttcagaaaacaaaaca

SEQ ID NO: 6830 - DNA, 50 bp, Homo sapiens
atcatgtctcattaacagagtgaagatggagcaacgtcatccagcttctg

SEQ ID NO: 6831 - DNA, 50 bp, Homo sapiens
tggtcgcgcccgaggtacggttttcatggtagggctgaatggaagatgtg

SEQ ID NO: 6832 - DNA, 50 bp, Homo sapiens
cagaaagataggagtgtgcaatggcaaggaaactcaatttaaagcaaatt

SEQ ID NO: 6833 - DNA, 50 bp, Homo sapiens
ttgcaaattctcatggtttgggttgggtggtggagagcgcgtgtcatctg

SEQ ID NO: 6834 - DNA, 50 bp, Homo sapiens
ttattcagcgtcacgatcagactgttacatttagcaatcaacagcatggg

SEQ ID NO: 6835 - DNA, 50 bp, Homo sapiens
tgtgtgtatgtgtgtaaccaggtctgactatagcttggtctgtctgtgtc

SEQ ID NO: 6836 - DNA, 50 bp, Homo sapiens
agcatttggggttttagctttggtgtcctaaatttcagtgatctttgcca

SEQ ID NO: 6837 - DNA, 50 bp, Homo sapiens
cataaaccagcagctcagcgtttctatagcaagcggtctcgagcacaagc

SEQ ID NO: 6838 - DNA, 50 bp, Homo sapiens
tagtgataggcgtggtggcggcgaaggtcagtaatggggcttttaaccag

SEQ ID NO: 6839 - DNA, 50 bp, Homo sapiens
tactgtagaaagaagaagagcacacatgagacagagaaggaggtggatgc

SEQ ID NO: 6840 - DNA, 50 bp, Homo sapiens
cgaggcggcccggcagggtaccaatttggatgaattcttgatagatttaa

SEQ ID NO: 6841 - DNA, 50 bp, Homo sapiens
ttgggttcagaatagcttcatctactgccgagcaaagtcaatacagcact

SEQ ID NO: 6842 - DNA, 50 bp, Homo sapiens
ggtaacagccatcccaccaccaataatcatctcattgtctttgtccagca

SEQ ID NO: 6843 - DNA, 50 bp, Homo sapiens
gtatgaatagattgccccattccctgccagcctggtagtgacttttccac

SEQ ID NO: 6844 - DNA, 50 bp, Homo sapiens
tataatttctaccaaactaagttttattttgtgcccgctccctgtccctt

SEQ ID NO: 6845 - DNA, 50 bp, Homo sapiens
ctgtaaaattcttttcgggtccatcctggctctcatctccagtgctttga

SEQ ID NO: 6846 - DNA, 56 bp, Homo sapiens
agggttaacaaaagtatggaattcaattctttttatatgctgcagccatgttcctg

SEQ ID NO: 6847 - DNA, 50 bp, Homo sapiens
cccaatctgaagtcagtaaatgaactaatctacaagcgtggttatggcaa

SEQ ID NO: 6848 - DNA, 50 bp, Homo sapiens
ccgaggtactctcttagagaaaggtgattggatgctccggttgcctgtaa

SEQ ID NO: 6849 - DNA, 50 bp, Homo sapiens
gcgggttggaaaatagtcgagaattgacagtccctctcgaagatgctttt

SEQ ID NO: 6850 - DNA, 50 bp, Homo sapiens
ttgagaccccaccaactgcaaaatctgttcctggcattaagctccttctt

SEQ ID NO: 6851 - DNA, 50 bp, Homo sapiens
aatgaaaaactccagctctcagctcacaaatctgtaatttaggtgtctct

SEQ ID NO: 6852 - DNA, 50 bp, Homo sapiens
tcgtcctggttaatctggaagtaacgtaattcgtaactctctttgctgtt

SEQ ID NO: 6853 - DNA, 50 bp, Homo sapiens
tcggttgttaagaactagagcttattcctattccaaatctatcttgcgct

SEQ ID NO: 6854 - DNA, 50 bp, Homo sapiens
agataagaacttcatcctaaagcatccgggccttggcatcttgtccatgc

SEQ ID NO: 6855 - DNA, 50 bp, Homo sapiens
actgatttcatcaagttcgacactggtaacctgtgtatggtgactggagg

SEQ ID NO: 6856 - DNA, 50 bp, Homo sapiens
aatcattggctacctcctccccttttacagtcacaagtccagatgtttgg

SEQ ID NO: 6857 - DNA, 50 bp, Homo sapiens
aataaatcccatacctcccattgaactaccacccaccccgaccaccataa

SEQ ID NO: 6858 - DNA, 50 bp, Homo sapiens
caagacatttccagccaacttcagaatgtagatctttgagccagacagct

SEQ ID NO: 6859 - DNA, 50 bp, Homo sapiens
gaggtactggcctgtgaagccctgaaggcactggcactggtaggaaccag

SEQ ID NO: 6860 - DNA, 50 bp, Homo sapiens
atcttctgtcaaagtcagtcgctgctccaagattgaaacagtctgtgtca

SEQ ID NO: 6861 - DNA, 50 bp, Homo sapiens
tggatggatttccaagtggcctcatatttatcatggtgctttaaatagca

SEQ ID NO: 6862 - DNA, 50 bp, Homo sapiens
ttcagcttagggaaagagagatacattttagattatagagcatcgcctgc

SEQ ID NO: 6863 - DNA, 50 bp, Homo sapiens
atcttcctatgtgcgccagataatgatcaagttcacaggtggtcttactt

SEQ ID NO: 6864 - DNA, 50 bp, Homo sapiens
agtttcttaagtcaaatgacacattagcccacgcaattcccagccccagc

SEQ ID NO: 6865 - DNA, 50 bp, Homo sapiens
ccctcttctgacatgaattaggcataatttagcaatcggttcttcccaaa

SEQ ID NO: 6866 - DNA, 50 bp, Homo sapiens
atacagtgaactggccactggctgtttgctatataaatggtatactgctt

SEQ ID NO: 6867 - DNA, 50 bp, Homo sapiens
aggttacttaaaagcatcattggcgtggtcctctcactaccaaagggcag

SEQ ID NO: 6868 - DNA, 50 bp, Homo sapiens
ctggggtcagcaaagaggggtagcaagtgtgccttagagatgaagaaatg

SEQ ID NO: 6869 - DNA, 50 bp, Homo sapiens
tttagagtacttagaggaggaccaggaaacactgagacagacacgcaggc

SEQ ID NO: 6870 - DNA, 50 bp, Homo sapiens
tgtttgaaaactaccttcatgggagcaatgacaagcacatgtctaggatt

SEQ ID NO: 6871 - DNA, 50 bp, Homo sapiens
tttgtgccaaggtttgggattttgtcttctagagcttcttctctattggt

SEQ ID NO: 6872 - DNA, 50 bp, Homo sapiens
tttttgacgctctctcactggtcttggcatttgatgtttctgttgaagcc

SEQ ID NO: 6873 - DNA, 50 bp, Homo sapiens
cctataatgggggaaagatgctggttagatgtttattttagtgggcttgc

SEQ ID NO: 6874 - DNA, 50 bp, Homo sapiens
ccacaaacacaccctgccacaagacatttagcacagaggaacagatccat

SEQ ID NO: 6875 - DNA, 50 bp, Homo sapiens
gacaccacaactcacctcctctattattagagatcccgagacattacggc

SEQ ID NO: 6876 - DNA, 50 bp, Homo sapiens
tgttacaatttcagcagttgaattcagtgaacactggttgaggagtgcct

SEQ ID NO: 6877 - DNA, 50 bp, Homo sapiens
ccttccgtattctcccaagtattcacaagccctcccttaaaaccctctct

SEQ ID NO: 6878 - DNA, 50 bp, Homo sapiens
acagccatctgggatgagccgcttttcagccaccatgtcttcaaattcat

SEQ ID NO: 6879 - DNA, 50 bp, Homo sapiens
taactgaatacagtctcatcttgccgcgcctggcttacctatctgtggaa

SEQ ID NO: 6880 - DNA, 50 bp, Homo sapiens
aggtactacacaaggtgtcagatggggttgccacaatgactaggacaaga

SEQ ID NO: 6881 - DNA, 50 bp, Homo sapiens; identical to SEQ ID NO: 363

SEQ ID NO: 6882 - DNA, 50 bp, Homo sapiens
gagagctttctccccgccttcagtttctgatggatctagccatgttgaaa

SEQ ID NO: 6883 - DNA, 50 bp, Homo sapiens
taaaactttctgccagggttccagagaaagagtaatttcctttgagtacc

SEQ ID NO: 6884 - DNA, 50 bp, Homo sapiens
cgctcgccgggccaggtaccaaaactttcataataaaaggtaggaaggat

SEQ ID NO: 6885 - DNA, 50 bp, Homo sapiens
tgacttcattgaaggctccatcacccaaagtagatgttaaaaaccttaat

SEQ ID NO: 6886 - DNA, 50 bp, Homo sapiens
tttatgtggaaggcttccctattacctcccagcgaaattcgtagtctttc

SEQ ID NO: 6887 - DNA, 50 bp, Homo sapiens
taaaatgttgccagtggaggaccgaatcaaggttattgctgacctcattt

SEQ ID NO: 6888 - DNA, 50 bp, Homo sapiens
agatatgttctgagccccgcccacacactgcctggttacagggagagaag

SEQ ID NO: 6889 - DNA, 50 bp, Homo sapiens
gaggttccttcatcccagaagaagcaacaggatttccagatcagggcaac

SEQ ID NO: 6890 - DNA, 50 bp, Homo sapiens
ctggtctgtgtcgttggctttatgacaggaagtgcctgtgggttatctta

SEQ ID NO: 6891 - DNA, 50 bp, Homo sapiens
cccaacgcttgtgtgcgtatgtatgtgtgtatttaacatcctgttcccat

SEQ ID NO: 6892 - DNA, 50 bp, Homo sapiens
gcataaaggcagccatttccattctctacattctctagtgatagcagagg

SEQ ID NO: 6893 - DNA, 50 bp, Homo sapiens
cgttacgcaatggagaagtccccttgaggctgaataatcacatctgtatc

SEQ ID NO: 6894 - DNA, 50 bp, Homo sapiens
aggccaaatcaccgcacagttgaattgctgattctaattggtaacaataa

SEQ ID NO: 6895 - DNA, 50 bp, Homo sapiens
ttgtagtgtaattgtgtgatacgcaaacctttagttaacccaagtgatga

SEQ ID NO: 6896 - DNA, 50 bp, Homo sapiens
ccttgttgccgtgggtatatgcatgatcttaccttttgtttgactatgaa

SEQ ID NO: 6897 - DNA, 50 bp, Homo sapiens
aaatgatatgttaagcacccaaatcttcacatggaggggaagggggtggg

SEQ ID NO: 6898 - DNA, 50 bp, Homo sapiens
ggccaaagctgtttattatgagatctttgagtggaatcagcatgtctccc

SEQ ID NO: 6899 - DNA, 50 bp, Homo sapiens
ttaacagcattgaaggtgaaacagcacaatgtcccattccaaatttattt

SEQ ID NO: 6900 - DNA, 50 bp, Homo sapiens
aggtacgaaaatacattctggcatcacacccctgaacccaagactgttct

SEQ ID NO: 6901 - DNA, 50 bp, Homo sapiens
gaactacctactggcagttgggttcagggagatgggattgacttcgcctt

SEQ ID NO: 6902 - DNA, 50 bp, Homo sapiens
agagctaatatacagagtacctgacacactacctcaccaacagtttaact

SEQ ID NO: 6903 - DNA, 50 bp, Homo sapiens
gcccaggcaacaagaatacttttatctttgatccgttctgtttatccagt

SEQ ID NO: 6904 - DNA, 50 bp, Homo sapiens
ctgagggtagactgtgggcaaagaggacaactctccctcccctaagggac

SEQ ID NO: 6905 - DNA, 50 bp, Homo sapiens
tgcccagacctatttccttaggacagtattctaaagttcagtagtccagt

SEQ ID NO: 6906 - DNA, 50 bp, Homo sapiens
gccctgtcccttgagaggctcacagcgatggaggccacttttgttgtttg

SEQ ID NO: 6907 - DNA, 50 bp, Homo sapiens
accaaaaagggctacattaccaccactgtatcataaaagccagccacctt

SEQ ID NO: 6908 - DNA, 50 bp, Homo sapiens
agctgacgattttctatcccggcctatagtgcatgtatggcaattgagca

SEQ ID NO: 6909 - DNA, 50 bp, Homo sapiens
ccccaaaacaaacaaaataaaccacaccagatatcagtcacatccttgaa

SEQ ID NO: 6910 - DNA, 50 bp, Homo sapiens
agtctgttattgcctgattttgtccccaccttgttcaaatttccaaagct

SEQ ID NO: 6911 - DNA, 50 bp, Homo sapiens
ctcacagccgaagctctgatcctttgttctcaggaaacactcaggaagtg

SEQ ID NO: 6912 - DNA, 50 bp, Homo sapiens
agagaaaatgagagacagacagtgagtgggaaagtcagcgaaaaggaaaa

SEQ ID NO: 6913 - DNA, 50 bp, Homo sapiens
tccttgagtttatacaccgtgctatgagtgatgacagccaattcccatgc

SEQ ID NO: 6914 - DNA, 50 bp, Homo sapiens
tcgcttcaggggtcagccaaaagatagacagccaggtaacttgagtggac

SEQ ID NO: 6915 - DNA, 50 bp, Homo sapiens
ggacagtaccaaacactcccctcctcccctctgcctctttgcttacttag

SEQ ID NO: 6916 - DNA, 50 bp, Homo sapiens
gaccaaatactgaacttccaccctgcataataatcatgaacaccgcacca

SEQ ID NO: 6917 - DNA, 50 bp, Homo sapiens
aggtgagcagtgcctcagatacctgcaaaacctttctgcacaaatgtgct

SEQ ID NO: 6918 - DNA, 50 bp, Homo sapiens
cagatccaatgagggtcccatctcttcccacttcaatcccgtgttgttct

SEQ ID NO: 6919 - DNA, 50 bp, Homo sapiens
ccaaccaaaccatcaaacagcagggagctagtgaagaggtctattgttcc

SEQ ID NO: 6920 - DNA, 50 bp, Homo sapiens
acatcgcctaaaaccgtgcatcgtaaacatttacctcaaagtcatcctct

SEQ ID NO: 6921 - DNA, 50 bp, Homo sapiens
ttttcactcctctcagagtctactccacctctcctcactccccaggacac

SEQ ID NO: 6922 - DNA, 50 bp, Homo sapiens
agatctgtgttcgtctctaggtaataggaaacacaatccagacatgatct

SEQ ID NO: 6923 - DNA, 50 bp, Homo sapiens
ttcatgaactcggagaggtccatggtgcactcccgctcgtcctgggacac

SEQ ID NO: 6924 - DNA, 50 bp, Homo sapiens
ctggcaatattaacttgggttctgtttcatctctggctataagccataca

SEQ ID NO: 6925 - DNA, 50 bp, Homo sapiens
tgccattcttttgttgaacctgtaaaggtaaggcccagattctgaaacct

SEQ ID NO: 6926 - DNA, 50 bp, Homo sapiens
taaagcacttatgagaatgctgcatttgtacatgagctacgcctcatctt

SEQ ID NO: 6927 - DNA, 50 bp, Homo sapiens
gcacccacctcctcagttcagacaagcccagcacccaaataccactatct

SEQ ID NO: 6928 - DNA, 50 bp, Homo sapiens
agcgcatgagtgactcccatctatatatgtcagtcgtctctggtgcaagg

SEQ ID NO: 6929 - DNA, 50 bp, Homo sapiens
gaaacagtggcccgggtcgtagtgcgctgtccagatcttcacgctacacc

SEQ ID NO: 6930 - DNA, 50 bp, Homo sapiens
agtgcattcacactgatgataaacgatagtagcttcacaggtttgcttct

SEQ ID NO: 6931 - DNA, 50 bp, Homo sapiens
gcttcaaaattccttacccccaacctctggcaccccaaattgtatcacta

SEQ ID NO: 6932 - DNA, 50 bp, Homo sapiens
gaggaagggctggctcttactccccacaagaggtgttccttaggccacac

SEQ ID NO: 6933 - DNA, 50 bp, Homo sapiens
ccaatctaatttaaaccctcataacaggacataagcttgcgcccgcatct

SEQ ID NO: 6934 - DNA, 50 bp, Homo sapiens
tgctcaatgttttgcactgattttattcaatgttttgaagggcgttatga

SEQ ID NO: 6935 - DNA, 50 bp, Homo sapiens
tgctaacaacagcttctcggtatgttaatattctgctaactcctttctca

SEQ ID NO: 6936 - DNA, 50 bp, Homo sapiens
ggaggaatggctgtgcccgtcccctccacttaagcgacctgagtctccag

SEQ ID NO: 6937 - DNA, 50 bp, Homo sapiens
acacacacttaagagtacagatgagagccaaaaataagtggcaggtcttt

SEQ ID NO: 6938 - DNA, 50 bp, Homo sapiens
ttttgtgactgtgcatgcttgaaaagaataagttttctgcagctgtgtct

SEQ ID NO: 6939 - DNA, 50 bp, Homo sapiens
cttgtctgtggcgtggcacacagtaggtgctcggtttgtgttgttgaatg

SEQ ID NO: 6940 - DNA, 50 bp, Homo sapiens
gaattctgaatacatgttggactgtgtttctttgacctgtgtttcctagg

SEQ ID NO: 6941 - DNA, 50 bp, Homo sapiens
tgagtccttggcctcagcttctaatctcaaacctaaaatagattgcgttt

SEQ ID NO: 6942 - DNA, 50 bp, Homo sapiens
tcttctcgtctttgctattaaatttcttcacggaccatgcatctggagga

SEQ ID NO: 6943 - DNA, 50 bp, Homo sapiens
ccagagactcctaagcagaatcaaggatgtgtggcataagcatgagagcc

SEQ ID NO: 6944 - DNA, 50 bp, Homo sapiens
cccataaagaggaataagctactgtcctcagctcttgttagctcaggctt

SEQ ID NO: 6945 - DNA, 50 bp, Homo sapiens
agagtttgtaacacaatccagtccacatgcttatccaatcccatcatcca

SEQ ID NO: 6946 - DNA, 50 bp, Homo sapiens
agctcaaaatatggcaaagtgatgatttcgtgttaatcctagaaacagca

SEQ ID NO: 6947 - DNA, 50 bp, Homo sapiens
tgggtctgctttcacatgaaagtgctacgaattctcttttgtgctgagcc

SEQ ID NO: 6948 - DNA, 50 bp, Homo sapiens
ggatgagcccactcacagcaccagatttgtactgaaagtaccttaatatc

SEQ ID NO: 6949 - DNA, 50 bp, Homo sapiens
aacccaaatccaaatgccaggatagaagaatttgtttatgagaaactgga

SEQ ID NO: 6950 - DNA, 50 bp, Homo sapiens
cgctttttgatctgattactatttcacacaggttacagctatgaccatga

SEQ ID NO: 6951 - DNA, 50 bp, Homo sapiens
ctgccgctaattcactagtaatttcgatcgtccgccctccaggtacatat

SEQ ID NO: 6952 - DNA, 50 bp, Homo sapiens
aggcgtgctattaattatcccataccctccttacagaaattacactcgca

SEQ ID NO: 6953 - DNA, 50 bp, Homo sapiens
gggagaagttctttaaactaagggtacaaaatgaattgaatgctgggggc

SEQ ID NO: 6954 - DNA, 50 bp, Homo sapiens
attagcgtgttcgcgcccgaggtacaccaaaaccttcagaaagcaaagtt

SEQ ID NO: 6955 - DNA, 50 bp, Homo sapiens
aagatatgaaatatgcctacccgcagagcttggcacaaagtggagtcaat

SEQ ID NO: 6956 - DNA, 50 bp, Homo sapiens
gtacagagatcggatcacacaagcccggagacagtgcagcttctccactg

SEQ ID NO: 6957 - DNA, 50 bp, Homo sapiens
aatgcacttgtgataaactgacagcagggttagacattactttcaaagct

SEQ ID NO: 6958 - DNA, 50 bp, Homo sapiens
ccactgctcaggaaactgcctgttcggtgctcctccaattcaattaagct

SEQ ID NO: 6959 - DNA, 50 bp, Homo sapiens
agtgctggtataactgcagaaagagatagagaagagagatcagtgagagc

SEQ ID NO: 6960 - DNA, 50 bp, Homo sapiens
aagtcaggacctttgcacttgccccgcctctgccttcacagctcttctca

SEQ ID NO: 6961 - DNA, 50 bp, Homo sapiens
taatcagggaagagcttgagatcattagcaactgaactgaacagggagtt

SEQ ID NO: 6962 - DNA, 50 bp, Homo sapiens
ctgggtcacgtcgcccaccaatggtatctgtgtggttaggcattaggctg

SEQ ID NO: 6963 - DNA, 50 bp, Homo sapiens
ggtggtaggtgagtgggtattgcgggctagtatccgagcaaaagatggtg

SEQ ID NO: 6964 - DNA, 50 bp, Homo sapiens
cagccctgctatctctggttgttcatgtacttctgtaaggtggagaccct

SEQ ID NO: 6965 - DNA, 50 bp, Homo sapiens
gaaggtgagaaacccgagagacaccaactatgatttttacttttcctggt

SEQ ID NO: 6966 - DNA, 50 bp, Homo sapiens
accacccctcccttccctcctttaactcatctcgaatctctctcatacat

SEQ ID NO: 6967 - DNA, 50 bp, Homo sapiens
ctcttatcctgctctgccctggaacttgaaccccagtgccaatactcatg

SEQ ID NO: 6968 - DNA, 50 bp, Homo sapiens
cgacctaatctctgtccccagaaggcagaccaggactccagccccaggag

SEQ ID NO: 6969 - DNA, 50 bp, Homo sapiens
gccaaatctttgtcctgtacaaagtacagatgtttttgactgaagttcca

SEQ ID NO: 6970 - DNA, 50 bp, Homo sapiens
gccacagtgaataaatacaaggcaaggctcataggtaaaacaagttctat

SEQ ID NO: 6971 - DNA, 50 bp, Homo sapiens; identical to SEQ ID NO: 5545

SEQ ID NO: 6972 - DNA, 50 bp, Homo sapiens
aaacccacccatcatttgccctgactacccatctcccgattaattcaccc

SEQ ID NO: 6973 - DNA, 50 bp, Homo sapiens
agggaacagagccaggatttaaactctaacaatttgtctccacaattgca

SEQ ID NO: 6974 - DNA, 50 bp, Homo sapiens
ctcctggcacgacagaactagtagtttccatgtcttgaggacataggtcc

SEQ ID NO: 6975 - DNA, 50 bp, Homo sapiens
tcgaacctgttccaggtatgctgatagatgtcggtagggcatccttaatt

SEQ ID NO: 6976 - DNA, 50 bp, Homo sapiens
gaggtactataaaccagatgcccaaaacacctgccctcctgggttggccg

SEQ ID NO: 6977 - DNA, 50 bp, Homo sapiens
acattcatctgtttccactgaggtctgagtcttcaagttttcaccccagc

SEQ ID NO: 6978 - DNA, 50 bp, Homo sapiens
ttagcccttttctgcgctaattagaatttcaagcgtcacagagcctgggg

SEQ ID NO: 6979 - DNA, 50 bp, Homo sapiens
ttcaacgaggtgaaccagtgtgatgtctgtggggaaaacacgtagtcagg

SEQ ID NO: 6980 - DNA, 53 bp, Homo sapiens
ggaaaaaagaaatttcctgagatttccagtgtatacagaagtgtctttccatt

SEQ ID NO: 6981 - DNA, 50 bp, Homo sapiens
gagttcacgtggggtggccctcctcagtgctcttagggtactgtactgtc

SEQ ID NO: 6982 - DNA, 50 bp, Homo sapiens
ccaccttcgaggtcccttccggcctaagatgcctgaaatctccaaggaaa

SEQ ID NO: 6983 - DNA, 50 bp, Homo sapiens
acaaggcaaagcttaaagaaacactaaacgaatgagtgaaagaagcggag

SEQ ID NO: 6984 - DNA, 50 bp, Homo sapiens
ttctcaataacaaacccagggctttcataaatgcatgatcaaaatgtgga

SEQ ID NO: 6985 - DNA, 50 bp, Homo sapiens
acagaaaatagggtgtatatcagcattacgctgattcagcagaagatagc

SEQ ID NO: 6986 - DNA, 50 bp, Homo sapiens
tctcgactgacacccactataaattccctgggttgaaaaacttttctttt

SEQ ID NO: 6987 - DNA, 50 bp, Homo sapiens
tccaaacccctccattacaatctaacacacttccccctacatcgtctcct

SEQ ID NO: 6988 - DNA, 50 bp, Homo sapiens
gcatttattttcttctacagagaacctggcggctgggtctgggaaagagc

SEQ ID NO: 6989 - DNA, 50 bp, Homo sapiens
acccacaattagtgagagtgcccttgagcttgagattcccattcctcctt

SEQ ID NO: 6990 - DNA, 50 bp, Homo sapiens
tggatataaagtgtgtgttctgacagaaaatggggagaaggtggctattt

SEQ ID NO: 6991 - DNA, 50 bp, Homo sapiens
gccagaaaatcctggtttccctggtgtcccctccaatctcttttaccaaa

SEQ ID NO: 6992 - DNA, 50 bp, Homo sapiens
ccattgtcgcccggagctggaaagatagtttagagaatgccttagcactt

SEQ ID NO: 6993 - DNA, 50 bp, Homo sapiens
cagcacccagtacaggtatgcaggaaggactcgcttgacttagagagtgg

SEQ ID NO: 6994 - DNA, 50 bp, Homo sapiens
aacacaccagaaggaaaagacacagacagggaatgaagcctgcaaagtcc

SEQ ID NO: 6995 - DNA, 50 bp, Homo sapiens
gtaactcagtgcccccaaagattcatagtcagcaggattggccagcaaat

SEQ ID NO: 6996 - DNA, 50 bp, Homo sapiens
cgccccaaatataaaatctcaataccagttccttttccccagtaccccag

SEQ ID NO: 6997 - DNA, 50 bp, Homo sapiens
agtcacaggatgttctctgcacctcatctgcaactctgagccttactcaa

SEQ ID NO: 6998 - DNA, 50 bp, Homo sapiens
gttagagccctcgtgccctgcttcttcagctaccatttctctctgtgacc

SEQ ID NO: 6999 - DNA, 50 bp, Homo sapiens
ccaccacaaccacacacacaaaaagtcaacccacacgaatataccggaaa

SEQ ID NO: 7000 - DNA, 50 bp, Homo sapiens
cagttgggctgttagtagtctgtcacacaggtgagaggagcaagagatcc

SEQ ID NO: 7001 - DNA, 50 bp, Homo sapiens
aatctattatcaggcatttaatcactgagcactcttctgtcccacactgt

SEQ ID NO: 7002 - DNA, 50 bp, Homo sapiens
agaggagtgacggtgaatggtactgaaagcggttgtaaattgcgagagag

SEQ ID NO: 7003 - DNA, 50 bp, Homo sapiens
tctccttgttctgattctctccccatctacaacaactccactccccaaag

SEQ ID NO: 7004 - DNA, 50 bp, Homo sapiens
cacctaaccaagcgggttgggctgatgaccgatgaccgtaagcagtaagg

SEQ ID NO: 7005 - DNA, 50 bp, Homo sapiens
acctcttctttagcaacactaaccactccacactggggaaattatactct

SEQ ID NO: 7006 - DNA, 50 bp, Homo sapiens
actaccgcacaacagaacacatgaccaggtgagtgcagacacgacatcag

SEQ ID NO: 7007 - DNA, 50 bp, Homo sapiens
cagttttactcctggtcatctcttgtgagtgtggattcttctctgcccct

SEQ ID NO: 7008 - DNA, 50 bp, Homo sapiens
ttttattttggctgaagtttgggtatggctgcttgttggcctctgctggg

SEQ ID NO: 7009 - DNA, 50 bp, Homo sapiens
acagcttataaagcactttctcatgcacttcttctcgccgtatttgcaca

SEQ ID NO: 7010 - DNA, 50 bp, Homo sapiens
ggggctcaaacctgtgacttactgctaactaacatcaaaggaaaagctgg

SEQ ID NO: 7011 - DNA, 50 bp, Homo sapiens
atgatcattgatagatattctaagagcatgcaggaatgaggatgcgtgcc

SEQ ID NO: 7012 - DNA, 50 bp, Homo sapiens
gacaacaaacctgcttgcttggttacccacagcgcactgagtatagaagt

SEQ ID NO: 7013 - DNA, 50 bp, Homo sapiens
tcttcaattattcatgctctaaggcagtgtctgtcttcccaccatcccgc

SEQ ID NO: 7014 - DNA, 52 bp, Homo sapiens
tgagtatttttaaaatcccctgtttggatgcttccagctaaatagtctacct

SEQ ID NO: 7015 - DNA, 52 bp, Homo sapiens
tgggtttactcagatcttctccttcttaagtgagagttttaacctacatttt

SEQ ID NO: 7016 - DNA, 50 bp, Homo sapiens
gtccagagctagaagaaccaagtcttcctttcttcattcattgttcaggt

SEQ ID NO: 7017 - DNA, 50 bp, Homo sapiens
cttcttcttaggatctggagggaggggagtgttagagcttgtgagccatg

SEQ ID NO: 7018 - DNA, 50 bp, Homo sapiens
ctgaacgaaccagttcttttggactaccagttcttgaagtgaagctcaga

SEQ ID NO: 7019 - DNA, 50 bp, Homo sapiens
aacaaaagcactgacaagctcatatgaacaggctaaaaagtgagtgaagt

SEQ ID NO: 7020 - DNA, 50 bp, Homo sapiens
ttctctttctatatctagctaaattgcctgtgcgcctcccatcctcctca

SEQ ID NO: 7021 - DNA, 50 bp, Homo sapiens
acacacttgataaattagaccgatgcaaaccgcaagaatccaaatcagct

SEQ ID NO: 7022 - DNA, 50 bp, Homo sapiens
atagtaggtgagccagtagtgtgaatgcttgtcaagcttccaaggatgga

SEQ ID NO: 7023 - DNA, 50 bp, Homo sapiens
aaccaccacccagcttcctggtacaagcagggactctggctacagtgcta

SEQ ID NO: 7024 - DNA, 50 bp, Homo sapiens
tttcctcccctccctccccaatccacaaaacacgtaattctgactatcca

SEQ ID NO: 7025 - DNA, 50 bp, Homo sapiens
caacattcacaaaactggtccccgaattagtgagaaggttccaggagtgc

SEQ ID NO: 7026 - DNA, 50 bp, Homo sapiens
gagagattatagcacagtctcccagggctcagtcaggtcatccgcagcaa

SEQ ID NO: 7027 - DNA, 50 bp, Homo sapiens
ttcaatgctttgtcctcccctcgcagatgtttagaacagatcctccttct

SEQ ID NO: 7028 - DNA, 50 bp, Homo sapiens
tccctctctcagggctgggaaagaaaggttcatcttcactcagatgcaag

SEQ ID NO: 7029 - DNA, 50 bp, Homo sapiens
ttctgttggtctgccagctcatccattcatccatcacctgccagctagac

SEQ ID NO: 7030 - DNA, 50 bp, Homo sapiens
acacagttttggctcccttattttccccgtactcgaaacatttccatgca

SEQ ID NO: 7031 - DNA, 50 bp, Homo sapiens
accaaatcgcaaaaatacagaatgcctgtaaattgagtcacaccttaaaa

SEQ ID NO: 7032 - DNA, 50 bp, Homo sapiens
gagtccataaatctgcatttcatgtagttgtaagactttctcccaaaggt

SEQ ID NO: 7033 - DNA, 50 bp, Homo sapiens
tccatttgagttttcttcccatctctcacagttgattgttctgtcccttc

SEQ ID NO: 7034 - DNA, 50 bp, Homo sapiens
aaaattcagccctcctggattcacgtgcccaatgaaagtccccaaactag

SEQ ID NO: 7035 - DNA, 50 bp, Homo sapiens
tttaacaggaaaagcccaaaattatttttatgctgtctacaatctgggcc

SEQ ID NO: 7036 - DNA, 50 bp, Homo sapiens
agttgcactggttgttcttggctgcggtgcttctcacacaagaagcccag

SEQ ID NO: 7037 - DNA, 50 bp, Homo sapiens
tttcctttttcccttgtcccttggcttcccccatcaccgaatcccccttc

SEQ ID NO: 7038 - DNA, 50 bp, Homo sapiens
ctcccacgcctggccgtagtccagagcttcttctttttcatggttgggtt

SEQ ID NO: 7039 - DNA, 50 bp, Homo sapiens
gccagtgtacgttgccaggcatttcatgtaagagaaaactcaaatagcca

SEQ ID NO: 7040 - DNA, 50 bp, Homo sapiens
ccgtcttcttttgggtgtttcctcctagtttcggcggaaatcagagttca

SEQ ID NO: 7041 - DNA, 50 bp, Homo sapiens
atgaaccctcacctgctctgcagtgcagttttgattttagtcccagcaaa

SEQ ID NO: 7042 - DNA, 58 bp, Homo sapiens
agatatagatggtaaaatgtgatgcaatgtaaaaaaatggtaatacacacactctcca

SEQ ID NO: 7043 - DNA, 50 bp, Homo sapiens
tgagtgggcttctcttatggtacagtctcttctctatgaggggcttcaaa

SEQ ID NO: 7044 - DNA, 50 bp, Homo sapiens
tgggcttccaaatggtacaatggagtaatcaagctcatggactgagagtt

SEQ ID NO: 7045 - DNA, 50 bp, Homo sapiens
cttgaagctacttgtccctttctgtgccagaccacttaatggctacccac

SEQ ID NO: 7046 - DNA, 50 bp, Homo sapiens
ttcccagggcgctccatctacagccttactgtgactccactcagcaccag

SEQ ID NO: 7047 - DNA, 50 bp, Homo sapiens
attccccctaagctcctgtcccccgccatgcacgactggtcacatcaaaa

SEQ ID NO: 7048 - DNA, 50 bp, Homo sapiens
aagacacacccctcctgtttaataaaagttgtcccctcgacatgcataat

SEQ ID NO: 7049 - DNA, 50 bp, Homo sapiens
cctggttacaataatgaaactgtcgtggagtaaagagggaaacatgacca

SEQ ID NO: 7050 - DNA, 50 bp, Homo sapiens
agaacccacacactgggagacaataactgccattcatataaccaacagaa

SEQ ID NO: 7051 - DNA, 50 bp, Homo sapiens
cgccactgcttaaagattacagacaattcccaggtaaagttgccaggact

SEQ ID NO: 7052 - DNA, 50 bp, Homo sapiens
acaatgatgtttgaaacgcactctgaatctgtgaaagctagataagtcct

SEQ ID NO: 7053 - DNA, 50 bp, Homo sapiens
gccttcctcctcctccctcttgggcctatgtcctagataagcctgttaaa

SEQ ID NO: 7054 - DNA, 50 bp, Homo sapiens
tgtcaagatgacagatcttaatccagagtggaggctcgttcggcctggag

SEQ ID NO: 7055 - DNA, 50 bp, Homo sapiens
tttatgtttcagcctctttctctcccgttgagtcctgccacaagtcctgc

SEQ ID NO: 7056 - DNA, 50 bp, Homo sapiens
attgtccaggtgacttgacacttgcctaccggaaaagttgggatgttctt

SEQ ID NO: 7057 - DNA, 50 bp, Homo sapiens
taaaatatgccctaatttaaagggcgcagggtcccacaacaagccacaga

SEQ ID NO: 7058 - DNA, 50 bp, Homo sapiens
aaatctcttctcacgttctgtttgtcatttaatcaccaggtttttagcgc

SEQ ID NO: 7059 - DNA, 50 bp, Homo sapiens
gctactgatgggtggccctttattcttgtctttatttgttgtgtgcagga

SEQ ID NO: 7060 - DNA, 50 bp, Homo sapiens
aaaaattggtagctgcccccatgtggtatgatgtttaatttgaacaacat

SEQ ID NO: 7061 - DNA, 50 bp, Homo sapiens
acccggcacgtctcctcaaccccttaattcttttccagcttttcatatta

SEQ ID NO: 7062 - DNA, 50 bp, Homo sapiens
ctcaagagggcatagacattccacacgaggactgcattcgtcagggtaac

SEQ ID NO: 7063 - DNA, 50 bp, Homo sapiens
aacaaatacccaattaactgtattcccctttcccctatgactgctggtgt

SEQ ID NO: 7064 - DNA, 50 bp, Homo sapiens
ccgttgtccgaaagcttgcttccaactaaagaccagagatgggagggagt

SEQ ID NO: 7065 - DNA, 50 bp, Homo sapiens
tttagcccaaagaagactttcgcataaattctgccgtaacccttgttgga

SEQ ID NO: 7066 - DNA, 50 bp, Homo sapiens
caaagcagcaaatacagagcacacaacaatccttggcctgagcagaacaa

SEQ ID NO: 7067 - DNA, 50 bp, Homo sapiens
atatgaagatggattggatgaggactgacaaaacgaagacatgccgggcc

SEQ ID NO: 7068 - DNA, 50 bp, Homo sapiens
atgcctagtcagtcagtatttcttcttgctgcaggtgtctaaaaacccac

SEQ ID NO: 7069 - DNA, 50 bp, Homo sapiens
ccttcgcattcccccatccatgctccaagataatagatttttctttaaaa

SEQ ID NO: 7070 - DNA, 50 bp, Homo sapiens
ggggaacactttggtttgaaagcacagagcagtttgccatgtttcttctg

SEQ ID NO: 7071 - DNA, 50 bp, Homo sapiens
actgaatggtcgaaatcacatatgcaccacacatactgatcttaagtaac

SEQ ID NO: 7072 - DNA, 50 bp, Homo sapiens
cgaggtacagcaaagcgacccttggtgtcatagatcagacggaaattctc

SEQ ID NO: 7073 - DNA, 50 bp, Homo sapiens
tacagaagagcagagaccaaccttctcaaagttggtgagtattaacccag

SEQ ID NO: 7074 - DNA, 50 bp, Homo sapiens
ccagatttgctgatgtgttaggtagttgtggcacactcacctgtctttcc

SEQ ID NO: 7075 - DNA, 50 bp, Homo sapiens; identical to SEQ ID NO: 379

SEQ ID NO: 7076 - DNA, 50 bp, Homo sapiens
ttgaacattcgcaaagtaacatctctcactcccaacaccacagcttatcg

SEQ ID NO: 7077 - DNA, 50 bp, Homo sapiens
agtaaccaccaaagcatagttttagaagggctttcgcaaacctagccttt

SEQ ID NO: 7078 - DNA, 50 bp, Homo sapiens
tcttgcttgttcttctcgtttttgttttatcttccgcccggcagggtcag

SEQ ID NO: 7079 - DNA, 50 bp, Homo sapiens
gctctgaaacccctggaactcttgagcctaaaatgtatttttacaatctt

SEQ ID NO: 7080 - DNA, 50 bp, Homo sapiens
atctttgatgtgaagccctttaaaaataaacgtgaaggtgccagcttgca

SEQ ID NO: 7081 - DNA, 50 bp, Homo sapiens
acccagcctgatgttcatcttttccccctcttcattttccttctttgttt

SEQ ID NO: 7082 - DNA, 50 bp, Homo sapiens
agaaagactaacaccagaaatcatgctgcaacaccagaacatcctttgga

SEQ ID NO: 7083 - DNA, 50 bp, Homo sapiens
tcacaaaatatggctcaaggagtataaatcccctctcacgcacccacaaa

SEQ ID NO: 7084 - DNA, 50 bp, Homo sapiens
actaaccaaccaatgagaatactacttacctccacccatgctgtgaaccc

SEQ ID NO: 7085 - DNA, 50 bp, Homo sapiens
tgaccgcctcaaagaccaaaaggactctactccatattcttctcactgtc

SEQ ID NO: 7086 - DNA, 50 bp, Homo sapiens
gaatgaccacctgacgcattcagagctcaccttcttgttcttcagctgtt

SEQ ID NO: 7087 - DNA, 50 bp, Homo sapiens
ttggtagaaaccacccaaccataaaattcccaagcctgtactggtcagcc

SEQ ID NO: 7088 - DNA, 50 bp, Homo sapiens
cataagttgggtgaagaaatggtggttttaatcagtaatatagctccccc

SEQ ID NO: 7089 - DNA, 50 bp, Homo sapiens
ttctcatctcaatatcccccagagccccagtacctcataatacaagactt

SEQ ID NO: 7090 - DNA, 50 bp, Homo sapiens; identical to SEQ ID NO: 383

SEQ ID NO: 7091 - DNA, 50 bp, Homo sapiens
tacccaaagtctattcgtaagtgcatcttttctattagactggaagctcc

SEQ ID NO: 7092 - DNA, 50 bp, Homo sapiens
gatggttcagcaactgaggagctcagggtgacgggtccacagagcacaga

SEQ ID NO: 7093 - DNA, 50 bp, Homo sapiens
agaaattagaagatgactaccatttgctaaagtctatccacatgccagca

SEQ ID NO: 7094 - DNA, 50 bp, Homo sapiens
ccccctcgaccccctcacaccctttccagagaggccttaagattcccatt

SEQ ID NO: 7095 - DNA, 50 bp, Homo sapiens
tgtaaggtttcataaatttagagaccctagccagtcagtgacaatatgca

SEQ ID NO: 7096 - DNA, 52 bp, Homo sapiens
gagttgcttattccagtctctctaagatatatctccctttttagttgctgac

SEQ ID NO: 7097 - DNA, 50 bp, Homo sapiens
tggtgtaatgaacatgccgtattgcctttatggccagtttgagtccttcc

SEQ ID NO: 7098 - DNA, 50 bp, Homo sapiens
agggaaccccaaagagttaaaaccaggaccactatttcatagtcaacaaa

SEQ ID NO: 7099 - DNA, 50 bp, Homo sapiens
gtggtaaatgagagcattacagaccacccacatcagcctaaaatataatt

SEQ ID NO: 7100 - DNA, 50 bp, Homo sapiens
ccaccaaacccaacaggccgggacaaatgcaataccatacagaaacacag

SEQ ID NO: 7101 - DNA, 50 bp, Homo sapiens
ggccaaactttcttactctgccatttgttcaatgtcctaatgagcatgaa

SEQ ID NO: 7102 - DNA, 50 bp, Homo sapiens
atcaatcgggccaatccgaagtcagcaatcttgcatatgagtccattccc

SEQ ID NO: 7103 - DNA, 50 bp, Homo sapiens
tatttttaacaaaatcacacggaaggatttccttcccgtcccatgtgttg

SEQ ID NO: 7104 - DNA, 50 bp, Homo sapiens
cagatagtggtatttgggtgctgggcttgtctgacctgaggaggtggctg

SEQ ID NO: 7105 - DNA, 50 bp, Homo sapiens
aactccatagagaaagactacgaatttcgctgggaggtaatagggaagcc

SEQ ID NO: 7106 - DNA, 50 bp, Homo sapiens
gcatttaggaaagacaggtgagtgtgccacaactacctaacacatcagca

SEQ ID NO: 7107 - DNA, 50 bp, Homo sapiens
ttactttgtcttctctcaccatcctaaaacgttgttttgctgagcatgaa

SEQ ID NO: 7108 - DNA, 50 bp, Homo sapiens
ccccagacgaaaataccaaatgcatggagagctcccgtgagtggttaata

SEQ ID NO: 7109 - DNA, 50 bp, Homo sapiens
gcctaagtttccagaagactttgacgatggagagcatgcaaagcaggtaa

SEQ ID NO: 7110 - DNA, 50 bp, Homo sapiens
ttttgcagttcaaggattggtgggaaacgtttgtatgtgttggggtgggg

SEQ ID NO: 7111 - DNA, 50 bp, Homo sapiens
aatagatttccatttcttccttcgagttagttgggtattgggaccttgaa

SEQ ID NO: 7112 - DNA, 50 bp, Homo sapiens
cgacggtgttctggagtttcgatgagacatgtaagtaagagttctgtgca

SEQ ID NO: 7113 - DNA, 50 bp, Homo sapiens
atattcagcagtggctgtgaaattggatttgaattaccgggatacatgca

SEQ ID NO: 7114 - DNA, 50 bp, Homo sapiens
actggttttcattctagtgtcccccacccgtctagtttcattttcctgta

SEQ ID NO: 7115 - DNA, 50 bp, Homo sapiens
ttgggagtcaccaggttaaagcaaagcctcagtcactgaaagcagaaact

SEQ ID NO: 7116 - DNA, 50 bp, Homo sapiens
tcctgtgctccagaattagtgattgctttggtgcttaacttgaagtggga

SEQ ID NO: 7117 - DNA, 50 bp, Homo sapiens
catctgctctgcttcctcacacactagaaacaccactgcccccatccatg

SEQ ID NO: 7118 - DNA, 50 bp, Homo sapiens
tctgtgatttatagactgttttcaggaaacgatcttcccatctgtggtga

SEQ ID NO: 7119 - DNA, 50 bp, Homo sapiens
tcatttcaggtctaataaacacactaacctcggcagcactggagcgtctg

SEQ ID NO: 7120 - DNA, 50 bp, Homo sapiens
agcttaggatatctattagtgttcactgttcgggcaagaggcctaaaggg

SEQ ID NO: 7121 - DNA, 50 bp, Homo sapiens
tgggaacacactggcccattatatagagaaaaataaaacatgatccccat

SEQ ID NO: 7122 - DNA, 50 bp, Homo sapiens
ttgcttgatttcccaaaccactacctgaaggtggcttatggtctacagct

SEQ ID NO: 7123 - DNA, 50 bp, Homo sapiens
ttccaccacttcaagactgggggcaggtagagaagacaagcataagtaca

SEQ ID NO: 7124 - DNA, 50 bp, Homo sapiens
ttcttctctgcccctaacagaatgttcttctcttgcttcccacaccctcc

SEQ ID NO: 7125 - DNA, 50 bp, Homo sapiens
cagcacatcttctggtttacaagttgggtaactatgaaagctggagatgc

SEQ ID NO: 7126 - DNA, 50 bp, Homo sapiens
tatctaaattctacctttagcatccaactagctaccgtctggcactggcc

SEQ ID NO: 7127 - DNA, 50 bp, Homo sapiens
tccaatgctcaagtcactctgagtctttgctggtgtcaacctacaatgcc

SEQ ID NO: 7128 - DNA, 50 bp, Homo sapiens
acctcactatagtagccattaggtaaagatgggccatatccaaatgggct

SEQ ID NO: 7129 - DNA, 50 bp, Homo sapiens
aagaactattcctttgagaatctttcctactgggagttactgctgtgatt

SEQ ID NO: 7130 - DNA, 50 bp, Homo sapiens
tctgtgtgaacatacatacaggactttgattctacctgtgcctgaccatt

SEQ ID NO: 7131 - DNA, 50 bp, Homo sapiens
gtggagctgttggccttgctggatgcgggcactctctacaccttcaggta

SEQ ID NO: 7132 - DNA, 50 bp, Homo sapiens
tgtcagtggctctcactttgtttgaaattgttgctttgggaaaaacacag

SEQ ID NO: 7133 - DNA, 50 bp, Homo sapiens
gatgcagtgggttaggggttgggggtacagactgacttgagctcggagtc

SEQ ID NO: 7134 - DNA, 50 bp, Homo sapiens
tcaggcactcagtaaaggcaagacttgagtgatacataaagtcagttaca

SEQ ID NO: 7135 - DNA, 50 bp, Homo sapiens
ccttgggctgagtttgctggtcctgaagattacagttttggttagagaga

SEQ ID NO: 7136 - DNA, 50 bp, Homo sapiens
acagcaaacaaagtgttccaatcctctattaacccatttaaccaagagtt

SEQ ID NO: 7137 - DNA, 50 bp, Homo sapiens; identical to SEQ ID NO: 6930

SEQ ID NO: 7138 - DNA, 50 bp, Homo sapiens
aagtgtgattagaagcagctggaagtagcagaggaggtggaagttagtcc

SEQ ID NO: 7139 - DNA, 50 bp, Homo sapiens
caggagtaaaacagagctggttgtgtgatacctatgctgggtggaagact

SEQ ID NO: 7140 - DNA, 50 bp, Homo sapiens
ggtgactatcttaccggctcccagtaaactctgaacaatgtaccagctaa

SEQ ID NO: 7141 - DNA, 50 bp, Homo sapiens
gcttgaagatgtctcaacagaaaatcaccgacatgaggaagcatcacgct

SEQ ID NO: 7142 - DNA, 56 bp, Homo sapiens
aggaacatggctgcagcatataaaaagaattgaattccatacttttgttaaccctg

SEQ ID NO: 7143 - DNA, 50 bp, Homo sapiens
ggtgctgccataggtgccagtaatgaccgtttatgcggaaatcaattaca

SEQ ID NO: 7144 - DNA, 50 bp, Homo sapiens
tgaagtactataggactcaatgggaccagtagcagctccaagtggatcac

SEQ ID NO: 7145 - DNA, 50 bp, Homo sapiens
acacgggacctcctttgatctttctgagaattaatagagatttcatggca

SEQ ID NO: 7146 - DNA, 50 bp, Homo sapiens
ccaaaaggagaaagatgactagggtcacacttgaggatttgccaggtggg

SEQ ID NO: 7147 - DNA, 50 bp, Homo sapiens
gcatcttctttgaagacgggaactgtacttcaggttcttttctgtttagc

SEQ ID NO: 7148 - DNA, 50 bp, Homo sapiens
ggctcatttggttttaaagtctcttctatgccatcccaggggaggaggat

SEQ ID NO: 7149 - DNA, 50 bp, Homo sapiens
gactgtggacacctctcactgtgtcttcttggcaggcagagcttactgac

SEQ ID NO: 7150 - DNA, 50 bp, Homo sapiens
gcagggtgcagagcttcacagcaggtaggaagaagtaactaagtggaaac

SEQ ID NO: 7151 - DNA, 50 bp, Homo sapiens
cagctaaagccgtaggtcattgtgactgtccctgggatgtggattactct

SEQ ID NO: 7152 - DNA, 50 bp, Homo sapiens
ccagaatgcagcctacagaccaaatatcaatggacttggtgtagccctgc

SEQ ID NO: 7153 - DNA, 50 bp, Homo sapiens
tttaaaccaggtctggaaaaaggaaggagaggagggcattttagagaaga

SEQ ID NO: 7154 - DNA, 50 bp, Homo sapiens
gtggcttcgtaaaatagaagagcagtcactgtggaactaccaaatggcga

SEQ ID NO: 7155 - DNA, 50 bp, Homo sapiens
cacaccacagctggctgggagcagaggctgctggtctcatagtaatctac

SEQ ID NO: 7156 - DNA, 50 bp, Homo sapiens
tggagaaaatgagagacagacagtgagtgagaaagtcagcgaaaaggaaa

SEQ ID NO: 7157 - DNA, 50 bp, Homo sapiens
acctactgttgagattattcccctgtctccacactgccagaaacttacca

SEQ ID NO: 7158 - DNA, 50 bp, Homo sapiens
ccaaatgatactaggattaagccccaaagcaaagtcaagcaccaccatgg

SEQ ID NO: 7159 - DNA, 50 bp, Homo sapiens
tcccagagcaacaactaagtctcaactaatggacaaccaacacccactga

SEQ ID NO: 7160 - DNA, 50 bp, Homo sapiens
ccacagaatgggcatgtagtattgagatttgaatcatctgctgtccagcc

SEQ ID NO: 7161 - DNA, 50 bp, Homo sapiens
acctcatccggctgctcaagtgcaagcgtgacagcttccccaacttcctg

SEQ ID NO: 7162 - DNA, 50 bp, Homo sapiens
gacctggtgctgtcgccctggcatcttaataaaacctgcttatacttccc

SEQ ID NO: 7163 - DNA, 50 bp, Homo sapiens
gcataaggaagacttgctcccctgtcctatgaaagagaatagttttggag

SEQ ID NO: 7164 - DNA, 50 bp, Homo sapiens
gggactcatctttccctccttggtgattccgcagtgagagagtggctggg

SEQ ID NO: 7165 - DNA, 50 bp, Homo sapiens
agactggatcgcacacctttgcaacagatgtgttctgattctctgaacct

SEQ ID NO: 7166 - DNA, 50 bp, Homo sapiens
aagcaaataccttttacaagtgaaaggaagaatttttcttctgccgtcaa

SEQ ID NO: 7167 - DNA, 50 bp, Homo sapiens
gcaacaaatgcttctattccatagctacggcattgctcagtaagttgagg

SEQ ID NO: 7168 - DNA, 50 bp, Homo sapiens
tccgtgtagaggttacagccttttatgctgttgagctcccaggtaccaaa

SEQ ID NO: 7169 - DNA, 50 bp, Homo sapiens
gcccacttggatttatagtatagcccttcctcgactcccaccagacttgc

SEQ ID NO: 7170 - DNA, 50 bp, Homo sapiens
aagagctcctgagccccctgcccccagagcaataaagtcagctggctttc

SEQ ID NO: 7171 - DNA, 50 bp, Homo sapiens
gctcaacatggaaagaaggtacagaaagtgatgtgttcaaaacattagca

SEQ ID NO: 7172 - DNA, 50 bp, Homo sapiens
ttatataccctggtcccatctttctagggcctggatctgcttatagagca

SEQ ID NO: 7173 - DNA, 50 bp, Homo sapiens
gtttactccgtccctatcactggtgtggctgtgggcaaaccacttattgc

SEQ ID NO: 7174 - DNA, 50 bp, Homo sapiens
gaactgaagcctgcacagtgtccaccctgttcccactcccatctttcttc

SEQ ID NO: 7175 - DNA, 50 bp, Homo sapiens
gaagaccaagagagacaacagacgcagcaaacagccgaagcaccagacaa

SEQ ID NO: 7176 - DNA, 50 bp, Homo sapiens
aattcagaaaattgttgggaggacagcccttttgtgaaccttgtttgggg

SEQ ID NO: 7177 - DNA, 50 bp, Homo sapiens
tttacccagctctgaaggtcattgttcttgcctgtgtttgaataaaatca

SEQ ID NO: 7178 - DNA, 50 bp, Homo sapiens
gtctctgatgctttgtatcattcttgagcaatcgctcggtccgtggacaa

SEQ ID NO: 7179 - DNA, 50 bp, Homo sapiens
ggtaagcccctgagcctgggacctacatgtggtttgcgtaataaaacatt

SEQ ID NO: 7180 - DNA, 50 bp, Homo sapiens
tctggctctgaccggttgatggccttgagcgaatgaaatcatgaaattga

SEQ ID NO: 7181 - DNA, 50 bp, Homo sapiens
tgccctacatagcaattttctgtggcactgagaaaccatgtatgaccaca

SEQ ID NO: 7182 - DNA, 50 bp, Homo sapiens
gcagtgtactgtgtgcaataccaagggcatagctccctgtaatttgggaa

SEQ ID NO: 7183 - DNA, 50 bp, Homo sapiens
ctgagactagggtcccagcacagcccagaaacctttggccacaagaagtg

SEQ ID NO: 7184 - DNA, 50 bp, Homo sapiens
tcgccttccatggtttttaaatgcagtaaataacatttctggatgagact

SEQ ID NO: 7185 - DNA, 50 bp, Homo sapiens
gctttacccccgcaggacatacacaggagcctttgatctcattaaagaga

SEQ ID NO: 7186 - DNA, 50 bp, Homo sapiens
ggaatgtacctctccccaacactgttttgttagcgagcaccttttgacca

SEQ ID NO: 7187 - DNA, 50 bp, Homo sapiens
actcgctcagaagagggaactaagcatttttggcaaccaatgggcagata

SEQ ID NO: 7188 - DNA, 50 bp, Homo sapiens
agctgtgtgaacctctcttattggaaattctgttccgtgtttgtgtaggt

SEQ ID NO: 7189 - DNA, 50 bp, Homo sapiens
agtcccatacatttggaccatggcagctaattttgtaacttaagcattca

SEQ ID NO: 7190 - DNA, 50 bp, Homo sapiens
ctgcccccttcctggacttcgtgccttactgagtctctaagactttttct

SEQ ID NO: 7191 - DNA, 50 bp, Homo sapiens
ggataacatttctcatgaacccactgcccctctgcattttcctcactggt

SEQ ID NO: 7192 - DNA, 50 bp, Homo sapiens
cgcttaagaacattgcctctgggtgtcatgtggaccagacttctgaatag

SEQ ID NO: 7193 - DNA, 50 bp, Homo sapiens
gggttcaatcccttcagctcaggcggaccatttagatttaaattccactt

SEQ ID NO: 7194 - DNA, 50 bp, Homo sapiens
gctcctgccagggctgttaccgttgttttcttgaatcactcacaatgaga

SEQ ID NO: 7195 - DNA, 50 bp, Homo sapiens
aatctggcgaaaccttcgtttgagggactgatgtgagtgtatgtccacct

SEQ ID NO: 7196 - DNA, 50 bp, Homo sapiens
gactatgggctctgaagggggcaggagtcagcaataaagctatgtctgat

SEQ ID NO: 7197 - DNA, 50 bp, Homo sapiens
agggaggggacagatggggagcttttcttacctattcaaggaatacgtgc

SEQ ID NO: 7198 - DNA, 50 bp, Homo sapiens
accttctgaaagctcacagtacacattagtatgtataactggctttacca

SEQ ID NO: 7199 - DNA, 50 bp, Homo sapiens
tttaagggagtcaggaatagatgtatgaacagtcgtgtcactggatgcct

SEQ ID NO: 7200 - DNA, 50 bp, Homo sapiens
cccaccttccacctcttagcactggtgaccccaaaaatgaaaccatcaat

SEQ ID NO: 7201 - DNA, 50 bp, Homo sapiens
agaccagcagtgtttaaatctaaatacgttgtgagtctgttatctgtcct

SEQ ID NO: 7202 - DNA, 50 bp, Homo sapiens
acctcgacctcagagcctcccacccagaagatcctgcttccgtggttgag

SEQ ID NO: 7203 - DNA, 50 bp, Homo sapiens
gggcagtgggtcccagattggctcacactgagaatgtaagaactacaaac

SEQ ID NO: 7204 - DNA, 50 bp, Homo sapiens
tggccttaagttttctaattcaagcgggtttttggaaaaatttatggtct

SEQ ID NO: 7205 - DNA, 50 bp, Homo sapiens
tgcagagttataagccccaaacaggtcatgctccaataaaaatgattcta

SEQ ID NO: 7206 - DNA, 50 bp, Homo sapiens
ccaaacaatgatgtggattcttttgcacagaaatatttaaggtgggatgg

SEQ ID NO: 7207 - DNA, 50 bp, Homo sapiens
acaaaagtcaactgttgtctcttttcaaaccaaattgggagaattgttgc

SEQ ID NO: 7208 - DNA, 50 bp, Homo sapiens
gctggggactctagcctctgtgttcataaagacattaagaagtggatgga

SEQ ID NO: 7209 - DNA, 50 bp, Homo sapiens
ggagaatgacacatcaagctgctaacaattgggggaaggggaaggaagaa

SEQ ID NO: 7210 - DNA, 50 bp, Homo sapiens
acctgggtttaatacagctcacatcactgaatgttacacatgagtttaaa

SEQ ID NO: 7211 - DNA, 50 bp, Homo sapiens
cttaaggacgcctttgcctggcccctttattacagcccaacacggtaggc

SEQ ID NO: 7212 - DNA, 50 bp, Homo sapiens
tccatcagtgccatttcctgtagaactaaaggctgttccaagaatgtggg

SEQ ID NO: 7213 - DNA, 50 bp, Homo sapiens
atctgtaaagcactcagaaggcagccatccctagatgttggtttcatgta

SEQ ID NO: 7214 - DNA, 50 bp, Homo sapiens
tggttagattgttttcacttggtgatcatgtcttttccatgtgtacctgt

SEQ ID NO: 7215 - DNA, 50 bp, Homo sapiens
catgtcccttgaaacatgatagttacatacacagttttctctccacacat

SEQ ID NO: 7216 - DNA, 50 bp, Homo sapiens
aggtttcacatgaacctgttctaggctgtggacattggtgtggagaggtt

SEQ ID NO: 7217 - DNA, 50 bp, Homo sapiens
gacacttggggtccacaatcccaggtccatactctaggttttggatacca

SEQ ID NO: 7218 - DNA, 50 bp, Homo sapiens
agaaatgatttgcagctgagtgaatcaggaagtgacagtgatgactgaag

SEQ ID NO: 7219 - DNA, 50 bp, Homo sapiens
tcctgagagatggacaatgaaatatcagttggtggatatgtgtgatagct

SEQ ID NO: 7220 - DNA, 50 bp, Homo sapiens
ctttcagggcaggcagctgtgcatgttctctcaactaaaggtcttgtgag

SEQ ID NO: 7221 - DNA, 50 bp, Homo sapiens
gctggacacacggtgagattttctcgtatgtaaataaaaggcaatttggt

SEQ ID NO: 7222 - DNA, 50 bp, Homo sapiens
ctcaacgaaaggctcacactaacaggggaggattacagcaccacaatact

SEQ ID NO: 7223 - DNA, 50 bp, Homo sapiens
ccacactgaacccaattacacacagcgggagaacgcagtaaacagctttc

SEQ ID NO: 7224 - DNA, 50 bp, Homo sapiens
aggccctggaaaattttgtgcttccaacgtggccttcaattcttgctttt

SEQ ID NO: 7225 - DNA, 50 bp, Homo sapiens
tattaagcttgcccaggctcctgttcatgaaggttcccccagcggtggcc

SEQ ID NO: 7226 - DNA, 50 bp, Homo sapiens
gctataccactgactgtattgaaaaccaaagtattaagaggggaaacgcc

SEQ ID NO: 7227 - DNA, 50 bp, Homo sapiens
tcggggtcagttaagcctcagtattcttagcttttgttgattttggcact

SEQ ID NO: 7228 - DNA, 50 bp, Homo sapiens
atggtgcaaaccctggaacagtatgaattctgctacaaagtggtacaaga

SEQ ID NO: 7229 - DNA, 50 bp, Homo sapiens
agaagcagcgagtgcatgggctaattatcatcaatctttatgtatttgtt

SEQ ID NO: 7230 - DNA, 50 bp, Homo sapiens
ggaaatgttgctgtgggggattcattgtaactctccttgtgaactgctca

SEQ ID NO: 7231 - DNA, 50 bp, Homo sapiens
atgccaaattcctgacacgtggcgtttgaaaataccatggaacgtttcca

SEQ ID NO: 7232 - DNA, 50 bp, Homo sapiens
acattctgactccatctgcggcctcattaaggtgatagaaacatactagg

SEQ ID NO: 7233 - DNA, 50 bp, Homo sapiens
atgataatgttggcatctgtgataaactatcaatgaggctcccatcatgc

SEQ ID NO: 7234 - DNA, 50 bp, Homo sapiens
agagtcacatgtagaaaagcctccagtattaagctcctgaattcattcct

SEQ ID NO: 7235 - DNA, 50 bp, Homo sapiens
atggcaacaatgctgacagcaagcagtagatcctctgattccaattacca

SEQ ID NO: 7236 - DNA, 50 bp, Homo sapiens
gggaaccctcattaattagacaagaacaccaaggctatgaccacagcagc

SEQ ID NO: 7237 - DNA, 50 bp, Homo sapiens
ggctcaccagagtacccagaagaatcagtatggaattagaggacagtggc

SEQ ID NO: 7238 - DNA, 50 bp, Homo sapiens
attccaggccctcagtctttggcaatggccaccctggtgttggcatattg

SEQ ID NO: 7239 - DNA, 50 bp, Homo sapiens
gcatacataaaggcaaagaatgacaaaaggcttaatccacctagaagaca

SEQ ID NO: 7240 - DNA, 50 bp, Homo sapiens
atatagtgggagacaaaacacaggaggcgggggatatcatgtagcagagc

SEQ ID NO: 7241 - DNA, 50 bp, Homo sapiens
tctaatgtgccttggatatgtgccaaatgatggaaaagaaacagtaaact

SEQ ID NO: 7242 - DNA, 50 bp, Homo sapiens
gcttggctcatctggggtttgctgggcttaacacccaataaagaactttg

SEQ ID NO: 7243 - DNA, 50 bp, Homo sapiens
ctgcggttttggaaccttacctctcctccttagcccaatatgctgtcttg

SEQ ID NO: 7244 - DNA, 50 bp, Homo sapiens
tccaggccattttgcagggactctgaagtgacctttagtagtaatagtct

SEQ ID NO: 7245 - DNA, 50 bp, Homo sapiens
tggcagccaggaactgagtatgacaatgttgtactaaagaaaggcccaaa

SEQ ID NO: 7246 - DNA, 50 bp, Homo sapiens
agagagagacatatcacgctgctgtcatgattttgtgtcaagatgatcca

SEQ ID NO: 7247 - DNA, 50 bp, Homo sapiens
cttctggggacctttcctacccccatcagcatcaataaaacctcctgtct

SEQ ID NO: 7248 - DNA, 50 bp, Homo sapiens
tagatgatttctagcaggcaggaagtcctgtgcggtgtcaccatgagcac

SEQ ID NO: 7249 - DNA, 50 bp, Homo sapiens
ccatggtctggggcttgaggaagatgagtttgttgatttaaataaagaat

SEQ ID NO: 7250 - DNA, 50 bp, Homo sapiens
aggtcaagggcttactatttctgggtcttttgctactaagttcacattag

SEQ ID NO: 7251 - DNA, 50 bp, Homo sapiens
tttctggggacctcttgaattacatgctgtaacatatgaagtgatgtggt

SEQ ID NO: 7252 - DNA, 50 bp, Homo sapiens
tggcacaaaacctcctcctcccaggcactcatttatattgctctgaaaga

SEQ ID NO: 7253 - DNA, 50 bp, Homo sapiens
tgaggtcactgccacttctcacatgctgcttaagggagcacaaataaagg

SEQ ID NO: 7254 - DNA, 50 bp, Homo sapiens
cacgctaccccctgccttgggaggtgtgtggaataaattatttttgttaa

SEQ ID NO: 7255 - DNA, 50 bp, Homo sapiens
aatgcagagaatggaaagtagcgcatccctgaggctggactccagatctg

SEQ ID NO: 7256 - DNA, 50 bp, Homo sapiens
gtggcacaccactccttccagcagtagtcgctttactgttacctgtttag

SEQ ID NO: 7257 - DNA, 50 bp, Homo sapiens
agcaacagtattctgcatggttcactgcttaagaaaatgccttctggaat

SEQ ID NO: 7258 - DNA, 50 bp, Homo sapiens
aaacatgtccctggagagtagcctgctcccacactgtcactggatgtcat

SEQ ID NO: 7259 - DNA, 50 bp, Homo sapiens
cagttgcagcctcttgacctcggataacaataagagagctcatctcattt

SEQ ID NO: 7260 - DNA, 50 bp, Homo sapiens
tgggcttggtcttccagttggcatttgcctgaagttgtattgaaacaatt

SEQ ID NO: 7261 - DNA, 50 bp, Homo sapiens
ttctgccgtgtgtatccccaacccttgacccaatgacaccaaacacagtg

SEQ ID NO: 7262 - DNA, 50 bp, Homo sapiens
tgtgtgcgacagggaggaagtttcaataaagcaacaacaagcttcaagga

SEQ ID NO: 7263 - DNA, 50 bp, Homo sapiens
ctccccttgggcggctgagagccccagctgacatggaaatacagttgttg

SEQ ID NO: 7264 - DNA, 50 bp, Homo sapiens
ctccaccacctgaccagagtgttctcttcagaggactggctcctttccca

SEQ ID NO: 7265 - DNA, 50 bp, Homo sapiens
ctctgccctcctgtcacccagtagagtaaataaacttccttggctcctaa

SEQ ID NO: 7266 - DNA, 50 bp, Homo sapiens
aaattccagccttgactttcttctgtgcacctgatgggagggtaatgtct

SEQ ID NO: 7267 - DNA, 50 bp, Homo sapiens
ctgtaggccagggtggaatgaagtcagctcctttttatagttgaaataca

SEQ ID NO: 7268 - DNA, 50 bp, Homo sapiens
ttggcgggccatcccaacaggtgatgaccccacaaggaagaggtactgtt

SEQ ID NO: 7269 - DNA, 50 bp, Homo sapiens
ggaagatggaaataaacctgcgtgtgggtggagtgttctcgtgccgaatt

SEQ ID NO: 7270 - DNA, 50 bp, Homo sapiens
agtgaggacaatgtggcttgctcctttttgaatctacagataatgcatgt

SEQ ID NO: 7271 - DNA, 50 bp, Homo sapiens
gagggtgggggagggaggtggagggagggaagggtttctctattaaaatg

SEQ ID NO: 7272 - DNA, 50 bp, Homo sapiens
tgctgactgtagctttggaagtttagctctgagaaccgtagatgatttca

SEQ ID NO: 7273 - DNA, 50 bp, Homo sapiens
gattgaggaaggtccgcacagcctgtctctgctcagttgcaataaacgtg

SEQ ID NO: 7274 - DNA, 50 bp, Homo sapiens
gattcttgtctggctaataaatcatcaccaactgccttctcctacaggga

SEQ ID NO: 7275 - DNA, 50 bp, Homo sapiens
agattcttagggcacgtttgttccccttggagggttttccacacggagtc

SEQ ID NO: 7276 - DNA, 50 bp, Homo sapiens
gccatactctggctgcctctttgccttcctaggggcattttctttaactt

SEQ ID NO: 7277 - DNA, 50 bp, Homo sapiens
tgcctcttatctacttgagagcaacatgtcttttcaatcatgggattgac

SEQ ID NO: 7278 - DNA, 50 bp, Homo sapiens
tggacctgtgacattctggactatttctgtgtttatttgtggccgagtgt

SEQ ID NO: 7279 - DNA, 50 bp, Homo sapiens
tgaaggtgtctgtgacctctttgatgtgcctgttctcaacctctgactga

SEQ ID NO: 7280 - DNA, 50 bp, Homo sapiens
cctggagtccctgaataaagataagaagcatcactgaagataatacctgg

SEQ ID NO: 7281 - DNA, 50 bp, Homo sapiens
ttgtcccgaagatttgcgcctttagtgccttttgaggggttcccatcatc

SEQ ID NO: 7282 - DNA, 50 bp, Homo sapiens
ctgctaggctctgcccaccggccaccaacactcctgtaattccaataaag

SEQ ID NO: 7283 - DNA, 50 bp, Homo sapiens
ttaaaatactgtcattggttgggaggggattgcattaaatgattagtcca

SEQ ID NO: 7284 - DNA, 50 bp, Homo sapiens
ctcacacacgcaggcgacagtcagaacaaacaggaacaaagctacaacac

SEQ ID NO: 7285 - DNA, 50 bp, Homo sapiens
tgaatagtgtgcagactcacagataataaagctcagagcagctcccggca

SEQ ID NO: 7286 - DNA, 50 bp, Homo sapiens
cccagtgcttcacgaagttaaaggaaagatctgctggtagtgtttagtct

SEQ ID NO: 7287 - DNA, 50 bp, Homo sapiens
cgagccgaccatgtcttcatttgcttccacaagaaccgcgaggacagagc

SEQ ID NO: 7288 - DNA, 50 bp, Homo sapiens
ttttccccctttagtctcctggctttttcctttcccttcccttctccact

SEQ ID NO: 7289 - DNA, 50 bp, Homo sapiens
aacccgttgtggaaattattggaattaactgagccaaagtgattatgcat

SEQ ID NO: 7290 - DNA, 50 bp, Homo sapiens
gcccccgatcctacaccctgagcctcagagcactgctactttttaaaata

SEQ ID NO: 7291 - DNA, 50 bp, Homo sapiens
aagcgtctcatggagttcggactggttggggtgataatatttgtttcttt

SEQ ID NO: 7292 - DNA, 50 bp, Homo sapiens
aagccaggctttgggatacaagttctttcctcttcatttgatgccgtgca

SEQ ID NO: 7293 - DNA, 50 bp, Homo sapiens
agctgtcaccactacagtaagctggtttacagatgttttccactgagcat

SEQ ID NO: 7294 - DNA, 50 bp, Homo sapiens
tgaaggtacatcgtttgcaaatgtgagtttcctctcctgtccgtgtttgt

SEQ ID NO: 7295 - DNA, 50 bp, Homo sapiens
ggatacaaactggtattctgttctggaggaaagggaggagtggaggtggg

SEQ ID NO: 7296 - DNA, 50 bp, Homo sapiens
ctgccgctgcccagccacatcccttggttttgtattttatttacagagtt

SEQ ID NO: 7297 - DNA, 50 bp, Homo sapiens
tgcagtagacgatacaggttgcatgtggacactcagtcacattaacaact

SEQ ID NO: 7298 - DNA, 50 bp, Homo sapiens
ccccaaccacaggcatcaggcaaccatttgaaataaaactccttcagcct

SEQ ID NO: 7299 - DNA, 50 bp, Homo sapiens
gtactgaggtgactggtatagtctgatgagaaagatgtggattgccataa

SEQ ID NO: 7300 - DNA, 50 bp, Homo sapiens
cacttgttcaatcatggaactttctagaacgctgccactcttcaaaggct

SEQ ID NO: 7301 - DNA, 50 bp, Homo sapiens
tcatcacagtgtggtaaggttgcaaattcaaaacatgtcacccaagctct

SEQ ID NO: 7302 - DNA, 50 bp, Homo sapiens
acaacctgatcattgaagccaactttgtcccagcacattccttaagtcct

SEQ ID NO: 7303 - DNA, 50 bp, Homo sapiens
acttgattaggctccggttttcctttggcttctgcttttcagtgaatggc

SEQ ID NO: 7304 - DNA, 50 bp, Homo sapiens
ttgcagacaaattcctctgagcttagctaggagttcattatgcttcctgt

SEQ ID NO: 7305 - DNA, 50 bp, Homo sapiens
acagtagcttagcatcagaggtttgcttcctcagtaacatttctgttctc

SEQ ID NO: 7306 - DNA, 50 bp, Homo sapiens
atgtgagccagagcatgttgcagcaaatctattgtttgtaaaaataacaa

SEQ ID NO: 7307 - DNA, 50 bp, Homo sapiens
tttgtgccatgtggctacattagttgatgtttatcgagttcattggtcaa

SEQ ID NO: 7308 - DNA, 50 bp, Homo sapiens
agcccaaccattaaaaatttaatacaacttggtttctccccctttttcct

SEQ ID NO: 7309 - DNA, 50 bp, Homo sapiens
gcaaagaaagaagaatccgaggagtctgatgatgacatgggctttggtct

SEQ ID NO: 7310 - DNA, 50 bp, Homo sapiens; identical to SEQ ID NO: 6184

SEQ ID NO: 7311 - DNA, 50 bp, Homo sapiens
ttttcctgaccaagactgagggatgggctggaggttttcaactttgctac

SEQ ID NO: 7312 - DNA, 50 bp, Homo sapiens
tctgggactgggcaaatgtttgtgtggcctccttaaactagctgttatgt

SEQ ID NO: 7313 - DNA, 50 bp, Homo sapiens
aacctaaacgtatttcactaactctggctccttctccataaagcacattt

SEQ ID NO: 7314 - DNA, 50 bp, Homo sapiens
ccaccaaatgcatgtcatgtattctcaataggctgtattcccagcagtca

SEQ ID NO: 7315 - DNA, 50 bp, Homo sapiens
tgtacaggtagctaactttgtaaacgctgtgtattccctctgcccccatg

SEQ ID NO: 7316 - DNA, 50 bp, Homo sapiens
tctcatcatttcgaagatagcagagtcatagttgggcacccagtgattgg

SEQ ID NO: 7317 - DNA, 50 bp, Homo sapiens
caacaaggtggaaacaagggctggagctgcgtttgttttgccatcactat

SEQ ID NO: 7318 - DNA, 50 bp, Homo sapiens
gagcattcctcaggggaggtcacctgtgaggttcccagaactgtagtttt

SEQ ID NO: 7319 - DNA, 50 bp, Homo sapiens
tgcaggtgttgacaagatccgccatctgtaatgtccttggcacaataaaa

SEQ ID NO: 7320 - DNA, 50 bp, Homo sapiens
aagagtctgacttctcactaggagcatgtctgttgtacttacttcaaaca

SEQ ID NO: 7321 - DNA, 50 bp, Homo sapiens
caaacaccaaaccaagataacaccggaacgataaacagcagaaacagaga

SEQ ID NO: 7322 - DNA, 50 bp, Homo sapiens
tgggtttgtccagttcaggctagatgtgcatcatggcaggaagaaagaag

SEQ ID NO: 7323 - DNA, 50 bp, Homo sapiens
aaggatgttccttcaggaggaagcagcactaaaagcactctgagtcaaga

SEQ ID NO: 7324 - DNA, 50 bp, Homo sapiens
cggaagccaccgtgtggttctttcacaggcacgtttattttgctgaaata

SEQ ID NO: 7325 - DNA, 50 bp, Homo sapiens
cctccactcagctgtcctgcagcaaacactccaccctccaccttccattt

SEQ ID NO: 7326 - DNA, 50 bp, Homo sapiens
tccctccttccagtgttccttagaacagacatttaggtatctcaggtcct

SEQ ID NO: 7327 - DNA, 50 bp, Homo sapiens
cagccgcagcatctaaacgaacaacagaggagaacgacgaggacagagtt

SEQ ID NO: 7328 - DNA, 50 bp, Homo sapiens
tcactggatttctgtgtcttcactagaacaccattgtcatctcatattga

SEQ ID NO: 7329 - DNA, 50 bp, Homo sapiens
gcttctctcgcacccccagcacctctgtcccaaaacctcattcccttttt

SEQ ID NO: 7330 - DNA, 50 bp, Homo sapiens
agctgctcacagacaccagcaaagcaatgtgctcctgatcaagtagattt

SEQ ID NO: 7331 - DNA, 50 bp, Homo sapiens
atgctcatgtggtgtccccaccgcccacttgtttgatgtcactgactgtc

SEQ ID NO: 7332 - DNA, 50 bp, Homo sapiens
gctgagtgtgtcgctccctggtccactgtttctcctataaatgtaaatgg

SEQ ID NO: 7333 - DNA, 50 bp, Homo sapiens
tgcagcacattgataagatggtttccgtgagctatgataagattgaaatt

SEQ ID NO: 7334 - DNA, 50 bp, Homo sapiens
ataaatatgcagtgatatggcagaagacaccagagcagatgcagagagcc

SEQ ID NO: 7335 - DNA, 50 bp, Homo sapiens
ttgaaccgggaagtgggaggacgtagagcagagaagagaacatttttaaa

SEQ ID NO: 7336 - DNA, 50 bp, Homo sapiens
tttgctcattctaaactcaagcttttaagcctcacagaatttacaggggt

SEQ ID NO: 7337 - DNA, 50 bp, Homo sapiens
gccataggcttacatggggcatactcgttacacagtcagaatgtttgaaa

SEQ ID NO: 7338 - DNA, 50 bp, Homo sapiens
ggtctctcgctctgtctttccagcatccactctcccttgtccttctgggg

SEQ ID NO: 7339 - DNA, 50 bp, Homo sapiens
tcagcaccaagtcatgtttaaaagaccagagagacaagcattttgccaag

SEQ ID NO: 7340 - DNA, 50 bp, Homo sapiens
cgaaccctgtctagaaggaatgtatttgttgctaaatttcgtagcactgt

SEQ ID NO: 7341 - DNA, 50 bp, Homo sapiens
caaatggccttggtcccgcagcttgtgtgcgtgagtgcagtgtgagtgtg

SEQ ID NO: 7342 - DNA, 50 bp, Homo sapiens
ctcttggaaagacttctctgccatccctttgcacctgagaggggaagttc

SEQ ID NO: 7343 - DNA, 50 bp, Homo sapiens
ggcgcggtgacccacttatgggacttggcctttctttgttgtttgtttaa

SEQ ID NO: 7344 - DNA, 52 bp, Homo sapiens
acccagttcatgattacttctactcttaacactcaatccccctaattaaacc

SEQ ID NO: 7345 - DNA, 50 bp, Homo sapiens
ttcgataaacagcgttgacttgcttgtaccacttaagagttgtgagtgct

SEQ ID NO: 7346 - DNA, 50 bp, Homo sapiens
tccagaactttgtctatcactctccccaacaacctagatgtgaaaacaga

SEQ ID NO: 7347 - DNA, 50 bp, Homo sapiens
gggatctttcaaatggatagtgagttgccttttcctataggtgacaatca

SEQ ID NO: 7348 - DNA, 50 bp, Homo sapiens
agagcaagcattacagaaaataggtctggaagacaggaaaaggacaaaga

SEQ ID NO: 7349 - DNA, 50 bp, Homo sapiens
atgtgtcctgcccctcagctctttgccttatctgtgtcactgtcacttta

SEQ ID NO: 7350 - DNA, 50 bp, Homo sapiens
tcctgtgaattgaatttctcttcaatcaaagtgccccaaacagaagcaca

SEQ ID NO: 7351 - DNA, 50 bp, Homo sapiens
aggtcccctgcctggtacaaagaaaagcaaaaagaatttacgaagattgt

SEQ ID NO: 7352 - DNA, 50 bp, Homo sapiens
gccagaagcataatttaccagagacgagaacagggtgtgggagagaggaa

SEQ ID NO: 7353 - DNA, 50 bp, Homo sapiens
tctttcttccctcgtgacagtggtgtgtggtgtcgtctgtgaatgctaag

SEQ ID NO: 7354 - DNA, 50 bp, Homo sapiens
cagtcaaacattttaccttgtgccttggctcactctgtgccttttctcca

SEQ ID NO: 7355 - DNA, 50 bp, Homo sapiens
acaggaaacgggctttctctgaattggtaaatgggaaagaagtgagcaac

SEQ ID NO: 7356 - DNA, 50 bp, Homo sapiens; identical to SEQ ID NO: 4610

SEQ ID NO: 7357 - DNA, 50 bp, Homo sapiens
accctcgccacaagattctgcaatctcctaaagtacagatgagaaaggaa

SEQ ID NO: 7358 - DNA, 50 bp, Homo sapiens
tgccaaggggttaatgaaacaaatagctgttgacgtttgctcatttaaga

SEQ ID NO: 7359 - DNA, 50 bp, Homo sapiens
cagtggcacaccttaaccagtcactaattttcactgttgtgaaagtgatt

SEQ ID NO: 7360 - DNA, 50 bp, Homo sapiens
cccagtgccacagagaagacgggatttgaagctgtacccaatttaattcc

SEQ ID NO: 7361 - DNA, 50 bp, Homo sapiens
tgagccctactccctgcagatgccaccctagccaatgtctcctccccttc

SEQ ID NO: 7362 - DNA, 50 bp, Homo sapiens
gcagggaggggaggataagtgggatctaccaattgattctggcaaaacaa

SEQ ID NO: 7363 - DNA, 50 bp, Homo sapiens
ggccactacctttgttggaaacaaagcataagggagtgaaagtgtctaaa

SEQ ID NO: 7364 - DNA, 50 bp, Homo sapiens
gctggcccgatctctccccacagttgcaagaagcattttcaaagaatagt

SEQ ID NO: 7365 - DNA, 50 bp, Homo sapiens
attgggatgaaactactttagcaaagtccacagatcagaaaccagacggt

SEQ ID NO: 7366 - DNA, 50 bp, Homo sapiens
aggagactgggtgctataattagattattttgaggcagacagagagctgt

SEQ ID NO: 7367 - DNA, 50 bp, Homo sapiens
agcctgcaaggttaggacttgaagagggaaggtatttaataactgggcga

SEQ ID NO: 7368 - DNA, 50 bp, Homo sapiens
ttagtgcagttggaatgaatgtgtataggtcagaggtcttcgtgttcaca

SEQ ID NO: 7369 - DNA, 50 bp, Homo sapiens
tcacctctcagttgaaagatttcttctttgaaaggtcaagaccgtgaact

SEQ ID NO: 7370 - DNA, 50 bp, Homo sapiens
agtctggatgtaaggcctgcctcaaagagacactaatgggagggaacaaa

SEQ ID NO: 7371 - DNA, 50 bp, Homo sapiens
aaaggaagaagcacgatgcaaacagaaacaagacgagacagagtgagcga

SEQ ID NO: 7372 - DNA, 50 bp, Homo sapiens
actgcttcaagtcttgacccctttgtgtctaatagctaaacaaacatgtg

SEQ ID NO: 7373 - DNA, 50 bp, Homo sapiens
aacaataggaataaggttacttcagccttaaggggcttatcatactgctg

SEQ ID NO: 7374 - DNA, 50 bp, Homo sapiens
gacagggaaatctgcctaccaagaggggtgtgtgtgtctttgtgcccaca

SEQ ID NO: 7375 - DNA, 50 bp, Homo sapiens
aacaagtccatgactcccaagggtttaaggaccaatggttcagtgagaca

SEQ ID NO: 7376 - DNA, 50 bp, Homo sapiens
acactcatactcatatgtacgtgctcagtcgaacggactgcagtccgttc

SEQ ID NO: 7377 - DNA, 50 bp, Homo sapiens
tactgctatggaatgagaccaccacttctcctgttgtccttcccagcttc

SEQ ID NO: 7378 - DNA, 50 bp, Homo sapiens
tgccaagtgaggacaaactgctaggctgtatcccataatttcaggatgag

SEQ ID NO: 7379 - DNA, 50 bp, Homo sapiens
aaaccgaccgcctgtaggctcctggaactatacagataggtaaagagttc

SEQ ID NO: 7380 - DNA, 50 bp, Homo sapiens
gaccaatcatcagactccttgaactcccccactctgctggctctgtaacc

SEQ ID NO: 7381 - DNA, 50 bp, Homo sapiens
agagatccaggtgcaagtggattgagacagcagcaacagctcaagagata

SEQ ID NO: 7382 - DNA, 50 bp, Homo sapiens
atgtccctttctcctctcccctcttcctcttactgctgttctccctttct

SEQ ID NO: 7383 - DNA, 50 bp, Homo sapiens
acatccatagaacaatacatcaaagttgttgaagtgttgcaggggagggc

SEQ ID NO: 7384 - DNA, 50 bp, Homo sapiens
agcacttactgtcaggcattcagaatgtgagcaatgacaataatttacct

SEQ ID NO: 7385 - DNA, 50 bp, Homo sapiens
aatctgattgagtctccactccacaagcactcagggttccccagcagctc

SEQ ID NO: 7386 - DNA, 50 bp, Homo sapiens
aacccaagaaaagagttgctcttactatctactgctgactcttgaacttt

SEQ ID NO: 7387 - DNA, 50 bp, Homo sapiens
ttcgtaggtgggcttttcctatcagagcttggctcataaccaaataaagt

SEQ ID NO: 7388 - DNA, 50 bp, Homo sapiens
aggtgggctggacttctacctgccctcaagggtgtgtatattgtataggg

SEQ ID NO: 7389 - DNA, 50 bp, Homo sapiens
tgtgtcagaatggcactagttcagtttatgtcccttctgatatagtagct

SEQ ID NO: 7390 - DNA, 50 bp, Homo sapiens
ctatcagccccaagtggagcagaacagagggatttgggaggaatgtcctc

SEQ ID NO: 7391 - DNA, 50 bp, Homo sapiens
tgctaaggagaggggccatgaagagttttgttgagaacatcgtgtctgag

SEQ ID NO: 7392 - DNA, 50 bp, Homo sapiens
agtcagaacttcaagtccccattaaaggggctggaaaatacaagtacagt

SEQ ID NO: 7393 - DNA, 50 bp, Homo sapiens
ctccccttcctgcacccgtacccccgtggtctttgaataaagtctgagtg

SEQ ID NO: 7394 - DNA, 50 bp, Homo sapiens
cagatggttgtggggtcaagtacatccccagtcgtggccctttggacaag

SEQ ID NO: 7395 - DNA, 50 bp, Homo sapiens
ttttggcctgtttgatgtatgtgtgaaacaatgttgtccaacaataaaca

SEQ ID NO: 7396 - DNA, 50 bp, Homo sapiens
agcctaggtgacagagcaagactccatttcaaaaacaaaacaaaacaaaa

SEQ ID NO: 7397 - DNA, 50 bp, Homo sapiens
acactgagaatacacgacatacacgcacgcacaagacaacaacagacagc

SEQ ID NO: 7398 - DNA, 50 bp, Homo sapiens; identical to SEQ ID NO: 6714

SEQ ID NO: 7399 - DNA, 50 bp, Homo sapiens; identical to SEQ ID NO: 6715

SEQ ID NO: 7400 - DNA, 50 bp, Homo sapiens; identical to SEQ ID NO: 6716

SEQ ID NO: 7401 - DNA, 50 bp, Homo sapiens; identical to SEQ ID NO: 6717

SEQ ID NO: 7402 - DNA, 50 bp, Homo sapiens; identical to SEQ ID NO: 6718

SEQ ID NO: 7403 - DNA, 50 bp, Homo sapiens; identical to SEQ ID NO: 6719

SEQ ID NO: 7404 - DNA, 50 bp, Homo sapiens; identical to SEQ ID NO: 6720

SEQ ID NO: 7405 - DNA, 50 bp, Homo sapiens; identical to SEQ ID NO: 6721

SEQ ID NO: 7406 - DNA, 50 bp, Homo sapiens; identical to SEQ ID NO: 6722

SEQ ID NO: 7407 - DNA, 50 bp, Homo sapiens; identical to SEQ ID NO: 6723

SEQ ID NO: 7408 - DNA, 50 bp, Homo sapiens; identical to SEQ ID NO: 6724

SEQ ID NO: 7409 - DNA, 50 bp, Homo sapiens; identical to SEQ ID NO: 6725

SEQ ID NO: 7410 - DNA, 50 bp, Homo sapiens; identical to SEQ ID NO: 6726

SEQ ID NO: 7411 - DNA, 50 bp, Homo sapiens; identical to SEQ ID NO: 6727

SEQ ID NO: 7412 - DNA, 50 bp, Homo sapiens; identical to SEQ ID NO: 6728

SEQ ID NO: 7413 - DNA, 50 bp, Homo sapiens; identical to SEQ ID NO: 6729

SEQ ID NO: 7414 - DNA, 50 bp, Homo sapiens; identical to SEQ ID NO: 6730

SEQ ID NO: 7415 - DNA, 50 bp, Homo sapiens; identical to SEQ ID NO: 6731

SEQ ID NO: 7416 - DNA, 50 bp, Homo sapiens; identical to SEQ ID NO: 6732

SEQ ID NO: 7417 - DNA, 50 bp, Homo sapiens; identical to SEQ ID NO: 6733

SEQ ID NO: 7418 - DNA, 50 bp, Homo sapiens; identical to SEQ ID NO: 6734

SEQ ID NO: 7419 - DNA, 50 bp, Homo sapiens; identical to SEQ ID NO: 6735

SEQ ID NO: 7420 - DNA, 50 bp, Homo sapiens; identical to SEQ ID NO: 6736

SEQ ID NO: 7421 - DNA, 50 bp, Homo sapiens; identical to SEQ ID NO: 6737

SEQ ID NO: 7422 - DNA, 50 bp, Homo sapiens; identical to SEQ ID NO: 6738

SEQ ID NO: 7423 - DNA, 50 bp, Homo sapiens; identical to SEQ ID NO: 4953

SEQ ID NO: 7424 - DNA, 50 bp, Homo sapiens; identical to SEQ ID NO: 6740

SEQ ID NO: 7425 - DNA, 50 bp, Homo sapiens; identical to SEQ ID NO: 6741

SEQ ID NO: 7426 - DNA, 50 bp, Homo sapiens; identical to SEQ ID NO: 6742

SEQ ID NO: 7427 - DNA, 50 bp, Homo sapiens; identical to SEQ ID NO: 6743

SEQ ID NO: 7428 - DNA, 50 bp, Homo sapiens; identical to SEQ ID NO: 6744

SEQ ID NO: 7429 - DNA, 50 bp, Homo sapiens; identical to SEQ ID NO: 6745

SEQ ID NO: 7430 - DNA, 50 bp, Homo sapiens; identical to SEQ ID NO: 6746

SEQ ID NO: 7431 - DNA, 50 bp, Homo sapiens; identical to SEQ ID NO: 6540

SEQ ID NO: 7432 - DNA, 50 bp, Homo sapiens; identical to SEQ ID NO: 6748

SEQ ID NO: 7433 - DNA, 50 bp, Homo sapiens; identical to SEQ ID NO: 6749

SEQ ID NO: 7434 - DNA, 50 bp, Homo sapiens; identical to SEQ ID NO: 6750

SEQ ID NO: 7435 - DNA, 50 bp, Homo sapiens; identical to SEQ ID NO: 6751

SEQ ID NO: 7436 - DNA, 56 bp, Homo sapiens
acaaaagtatggaattcaattctttttatatgctgcagccatgttcctgccctaga

SEQ ID NO: 7437 - DNA, 50 bp, Homo sapiens; identical to SEQ ID NO: 6753

SEQ ID NO: 7438 - DNA, 50 bp, Homo sapiens; identical to SEQ ID NO: 6754

SEQ ID NO: 7439 - DNA, 50 bp, Homo sapiens; identical to SEQ ID NO: 6755

SEQ ID NO: 7440 - DNA, 50 bp, Homo sapiens; identical to SEQ ID NO: 6756

SEQ ID NO: 7441 - DNA, 50 bp, Homo sapiens; identical to SEQ ID NO: 6757

SEQ ID NO: 7442 - DNA, 50 bp, Homo sapiens; identical to SEQ ID NO: 6758

SEQ ID NO: 7443 - DNA, 50 bp, Homo sapiens; identical to SEQ ID NO: 6759

SEQ ID NO: 7444 - DNA, 50 bp, Homo sapiens; identical to SEQ ID NO: 6760

SEQ ID NO: 7445 - DNA, 50 bp, Homo sapiens; identical to SEQ ID NO: 6761

SEQ ID NO: 7446 - DNA, 50 bp, Homo sapiens; identical to SEQ ID NO: 6762

SEQ ID NO: 7447 - DNA, 50 bp, Homo sapiens; identical to SEQ ID NO: 6763

SEQ ID NO: 7448 - DNA, 50 bp, Homo sapiens; identical to SEQ ID NO: 6764

SEQ ID NO: 7449 - DNA, 50 bp, Homo sapiens; identical to SEQ ID NO: 6765

SEQ ID NO: 7450 - DNA, 50 bp, Homo sapiens; identical to SEQ ID NO: 6766

SEQ ID NO: 7451 - DNA, 50 bp, Homo sapiens; identical to SEQ ID NO: 6767

SEQ ID NO: 7452 - DNA, 50 bp, Homo sapiens; identical to SEQ ID NO: 6768

SEQ ID NO: 7453 - DNA, 50 bp, Homo sapiens; identical to SEQ ID NO: 6769

SEQ ID NO: 7454 - DNA, 50 bp, Homo sapiens; identical to SEQ ID NO: 6770

SEQ ID NO: 7455 - DNA, 50 bp, Human cytomegalovirus; identical to SEQ ID NO: 4173

SEQ ID NO: 7456 - DNA, 50 bp, Human cytomegalovirus
ttttgcgaacttttaggaaccagcaagtcaacaaaagactaacaaagaaa

SEQ ID NO: 7457 - DNA, 50 bp, Homo sapiens; identical to SEQ ID NO: 4181

SEQ ID NO: 7458 - DNA, 50 bp, Homo sapiens; identical to SEQ ID NO: 4174

SEQ ID NO: 7459 - DNA, 50 bp, Human cytomegalovirus; identical to SEQ ID NO: 4177

SEQ ID NO: 7460 - DNA, 50 bp, Human cytomegalovirus; identical to SEQ ID NO: 4182

SEQ ID NO: 7461 - DNA, 50 bp, Human cytomegalovirus; identical to SEQ ID NO: 4179

SEQ ID NO: 7462 - DNA, 50 bp, Human cytomegalovirus; identical to SEQ ID NO: 4183

SEQ ID NO: 7463 - DNA, 50 bp, Human cytomegalovirus; identical to SEQ ID NO: 4175

SEQ ID NO: 7464 - DNA, 50 bp, Human cytomegalovirus; identical to SEQ ID NO: 4184

SEQ ID NO: 7465 - DNA, 50 bp, Human cytomegalovirus
ctgcatcgtcgtcgtcctcctcctctcggagatcgcgacggagaaacaac

SEQ ID NO: 7466 - DNA, 50 bp, Human cytomegalovirus
ctgagcctggccatcgaggcagccatccaggacctgaggaacaagtctca

SEQ ID NO: 7467 - DNA, 50 bp, Human cytomegalovirus; identical to SEQ ID NO: 4178

SEQ ID NO: 7468 - DNA, 50 bp, Human cytomegalovirus; identical to SEQ ID NO: 4180

SEQ ID NO: 7469 - DNA, 50 bp, Human adenovirus type 2
ctgtggaatgtatcgaggacttgcttaacgagtctgggcaacctttggac

SEQ ID NO: 7470 - DNA, 50 bp, Human adenovirus type 2
gctggcctgcacccgcgctgagtttggctctagcgatgaagatacagatt

SEQ ID NO: 7471 - DNA, 50 bp, Human adenovirus type 2
ggggcggttaggctgtcctccttctcgactgactccatgatctttttctg

SEQ ID NO: 7472 - DNA, 50 bp, Human adenovirus type 2
tgtttgccttattattatgtggcttatttgttgcctaaagcgcagacgcg

SEQ ID NO: 7473 - DNA, 50 bp, Homo sapiens
acggtgatcaatataagctatgtggtggtggggctatactactgaatgaa

SEQ ID NO: 7474 - DNA, 50 bp, Human adenovirus type 2
tttctgccctgaaggcttcctcccctcccaatgcggtttaaaacataaat

SEQ ID NO: 7475 - DNA, 50 bp, Human adenovirus type 2
ggcttatgcccatgtatctgaacatccagagtcacctttaccacgtcctg

SEQ ID NO: 7476 - DNA, 50 bp, Human adenovirus type 2
ctactgccgtacagcgaaagccgccccaacccgcgaaacgaggagatatg

SEQ ID NO: 7477 - DNA, 50 bp, Homo sapiens; identical to SEQ ID NO: 7104

SEQ ID NO: 7478 - DNA, 50 bp, Homo sapiens; identical to SEQ ID NO: 7105

SEQ ID NO: 7479 - DNA, 50 bp, Homo sapiens; identical to SEQ ID NO: 7106

SEQ ID NO: 7480 - DNA, 50 bp, Homo sapiens; identical to SEQ ID NO: 7107

SEQ ID NO: 7481 - DNA, 50 bp, Homo sapiens; identical to SEQ ID NO: 7108

SEQ ID NO: 7482 - DNA, 50 bp, Homo sapiens; identical to SEQ ID NO: 7109

SEQ ID NO: 7483 - DNA, 50 bp, Homo sapiens; identical to SEQ ID NO: 7110

SEQ ID NO: 7484 - DNA, 50 bp, Homo sapiens; identical to SEQ ID NO: 7111

SEQ ID NO: 7485 - DNA, 50 bp, Homo sapiens; identical to SEQ ID NO: 7112

SEQ ID NO: 7486 - DNA, 50 bp, Homo sapiens; identical to SEQ ID NO: 7113

SEQ ID NO: 7487 - DNA, 50 bp, Homo sapiens; identical to SEQ ID NO: 7114

SEQ ID NO: 7488 - DNA, 50 bp, Homo sapiens; identical to SEQ ID NO: 7115

SEQ ID NO: 7489 - DNA, 50 bp, Homo sapiens; identical to SEQ ID NO: 7116

SEQ ID NO: 7490 - DNA, 50 bp, Homo sapiens; identical to SEQ ID NO: 7117

SEQ ID NO: 7491 - DNA, 50 bp, Homo sapiens; identical to SEQ ID NO: 7118

SEQ ID NO: 7492 - DNA, 50 bp, Homo sapiens; identical to SEQ ID NO: 7119

SEQ ID NO: 7493 - DNA, 50 bp, Homo sapiens; identical to SEQ ID NO: 7120

SEQ ID NO: 7494 - DNA, 50 bp, Homo sapiens; identical to SEQ ID NO: 7121

SEQ ID NO: 7495 - DNA, 50 bp, Homo sapiens; identical to SEQ ID NO: 7122

SEQ ID NO: 7496 - DNA, 50 bp, Homo sapiens; identical to SEQ ID NO: 7123

SEQ ID NO: 7497 - DNA, 50 bp, Homo sapiens; identical to SEQ ID NO: 7124

SEQ ID NO: 7498 - DNA, 50 bp, Homo sapiens; identical to SEQ ID NO: 7125

SEQ ID NO: 7499 - DNA, 50 bp, Homo sapiens; identical to SEQ ID NO: 7126

SEQ ID NO: 7500 - DNA, 50 bp, Homo sapiens; identical to SEQ ID NO: 7127

SEQ ID NO: 7501 - DNA, 50 bp, Homo sapiens; identical to SEQ ID NO: 7128

SEQ ID NO: 7502 - DNA, 50 bp, Homo sapiens; identical to SEQ ID NO: 7129

SEQ ID NO: 7503 - DNA, 50 bp, Homo sapiens; identical to SEQ ID NO: 7130

SEQ ID NO: 7504 - DNA, 50 bp, Homo sapiens; identical to SEQ ID NO: 7131

SEQ ID NO: 7505 - DNA, 50 bp, Homo sapiens; identical to SEQ ID NO: 7132

SEQ ID NO: 7506 - DNA, 50 bp, Homo sapiens; identical to SEQ ID NO: 7133

SEQ ID NO: 7507 - DNA, 50 bp, Homo sapiens; identical to SEQ ID NO: 7134

SEQ ID NO: 7508 - DNA, 50 bp, Homo sapiens; identical to SEQ ID NO: 7135

SEQ ID NO: 7509 - DNA, 50 bp, Homo sapiens; identical to SEQ ID NO: 7136

SEQ ID NO: 7510 - DNA, 50 bp, Homo sapiens; identical to SEQ ID NO: 6930

SEQ ID NO: 7511 - DNA, 50 bp, Homo sapiens; identical to SEQ ID NO: 7138

SEQ ID NO: 7512 - DNA, 50 bp, Homo sapiens; identical to SEQ ID NO: 7139

SEQ ID NO: 7513 - DNA, 50 bp, Homo sapiens; identical to SEQ ID NO: 7140

SEQ ID NO: 7514 - DNA, 50 bp, Homo sapiens; identical to SEQ ID NO: 7141

SEQ ID NO: 7515 - DNA, 56 bp, Homo sapiens
tctagggcaggaacatggctgcagcatataaaaagaattgaattccatacttttgt

SEQ ID NO: 7516 - DNA, 50 bp, Homo sapiens; identical to SEQ ID NO: 7143

SEQ ID NO: 7517 - DNA, 50 bp, Homo sapiens; identical to SEQ ID NO: 7144

SEQ ID NO: 7518 - DNA, 50 bp, Homo sapiens; identical to SEQ ID NO: 7145

SEQ ID NO: 7519 - DNA, 50 bp, Homo sapiens; identical to SEQ ID NO: 7146

SEQ ID NO: 7520 - DNA, 50 bp, Homo sapiens; identical to SEQ ID NO: 7147

SEQ ID NO: 7521 - DNA, 50 bp, Homo sapiens; identical to SEQ ID NO: 7148

SEQ ID NO: 7522 - DNA, 50 bp, Homo sapiens; identical to SEQ ID NO: 7149

SEQ ID NO: 7523 - DNA, 50 bp, Homo sapiens; identical to SEQ ID NO: 7150

SEQ ID NO: 7524 - DNA, 50 bp, Homo sapiens; identical to SEQ ID NO: 7151

SEQ ID NO: 7525 - DNA, 50 bp, Homo sapiens; identical to SEQ ID NO: 7152

SEQ ID NO: 7526 - DNA, 50 bp, Homo sapiens; identical to SEQ ID NO: 7153

SEQ ID NO: 7527 - DNA, 50 bp, Homo sapiens; identical to SEQ ID NO: 7154

SEQ ID NO: 7528 - DNA, 50 bp, Homo sapiens; identical to SEQ ID NO: 7155

SEQ ID NO: 7529 - DNA, 50 bp, Homo sapiens; identical to SEQ ID NO: 7156

SEQ ID NO: 7530 - DNA, 50 bp, Homo sapiens; identical to SEQ ID NO: 7157

SEQ ID NO: 7531 - DNA, 50 bp, Homo sapiens; identical to SEQ ID NO: 7158

SEQ ID NO: 7532 - DNA, 50 bp, Homo sapiens; identical to SEQ ID NO: 7159

SEQ ID NO: 7533 - DNA, 50 bp, Homo sapiens; identical to SEQ ID NO: 7160

SEQ ID NO: 7534 - DNA, 50 bp, Homo sapiens
tactggcgtcgagcccactgcctcagaagacttcctttcatctgttccta

SEQ ID NO: 7535 - DNA, 50 bp, Homo sapiens
gtttcaagggacatcttcagagccaacatctaccctcggggctttgtgaa

SEQ ID NO: 7536 - DNA, 50 bp, Homo sapiens
ctacagttctaccataaacactcagtccccgtgtacttccctgcacagga

SEQ ID NO: 7537 - DNA, 50 bp, Homo sapiens
tagttgcatgtgacaacagagatcaacgacgagaccctccacagtatccg

SEQ ID NO: 7538 - DNA, 50 bp, Homo sapiens
ttgaccatagaatcaagcctgaggctgtgaagatggtgcaagtgtggaga

SEQ ID NO: 7539 - DNA, 50 bp, Homo sapiens
ctgctgtcttcacccgaatctcccattaccggccctggatcaaccagatc

SEQ ID NO: 7540 - DNA, 50 bp, Homo sapiens
gtcactggaggaccaacccctgctgtccaaaacaccactgcttcctaccc

SEQ ID NO: 7541 - DNA, 50 bp, Human herpesvirus type 4
catgccatgcatatttcaactgggctgtctatttttgacaccagcttatt

SEQ ID NO: 7542 - DNA, 50 bp, Human herpesvirus type 4
gagaagcacctcaacctggagacaattctactgttcaaacagcagcagca

SEQ ID NO: 7543 - DNA, 50 bp, Human herpesvirus type 4
acttgtcagggccattctctctccgggcactgggtcactaggactgtttt

SEQ ID NO: 7544 - DNA, 50 bp, Human herpesvirus type 4
gacagcgtcctagaaaccctggcgaccattgcctccagcgggatagagtg

SEQ ID NO: 7545 - DNA, 50 bp, Human herpesvirus type 4
catcctctggagcctgacctgtgatcgtcgcatcatagaccgccagtaga

SEQ ID NO: 7546 - DNA, 50 bp, Human herpesvirus type 4
gcctccacacgacatcacaccatataccgcaaggaatatcagggatgctg

SEQ ID NO: 7547 - DNA, 50 bp, Homo sapiens
acagccatcctccccttgagagtcatcagaaaaatacattaggaaaatgt

SEQ ID NO: 7548 - DNA, 50 bp, Human herpesvirus type 4
accttcgtcttctgagtctcatgcctcaaaacctagtttgatagacagga

SEQ ID NO: 7549 - DNA, 50 bp, Human herpesvirus type 4
agatggctacccttctgattatgatcctttcgtagaaaatgctcaaatct

SEQ ID NO: 7550 - DNA, 50 bp, Human herpesvirus type 4
atgcatcgccgacaagtcttgaattaggattgtcgaaattagacaaagaa

SEQ ID NO: 7551 - DNA, 50 bp, Human herpesvirus type 4
cgggtgtgttcaatcatcgacggtgacaatcctatctccatctataatcc

SEQ ID NO: 7552 - DNA, 50 bp, Human herpesvirus type 4
gaagagcgaaatgcaatcttctgcttcttcagtagagactttacagtctt

SEQ ID NO: 7553 - DNA, 50 bp, Human herpesvirus type 4
gcacatccatcgcccaaagtgaagtctgcaaggatgccatttattggttg

SEQ ID NO: 7554 - DNA, 50 bp, Human herpesvirus type 4
tctcggtttacctttttgctgttgtggttctttgttcttgctggtttgct

SEQ ID NO: 7555 - DNA, 50 bp, Human herpesvirus 4
tctgaatactctacaaaacgctccttgtctgctcttaaaaccatctgtgt

SEQ ID NO: 7556 - DNA, 50 bp, Human herpesvirus 6
tgaagctgacacctgtgaaactaacttaaacgcatgttcttctgactcag

SEQ ID NO: 7557 - DNA, 50 bp, Human herpesvirus 6
ttctgttttgggccaggaaccgttctataaattgttttattgactacacg

SEQ ID NO: 7558 - DNA, 50 bp, Human herpesvirus 6
taacaccgtccaagaaattttgccgttgtgtccccatacttctctagggc

SEQ ID NO: 7559 - DNA, 50 bp, Human herpesvirus 6
agaagaaggatcagatggagagttgaaaactttagctggtaagtacatga

SEQ ID NO: 7560 - DNA, 50 bp, Human herpesvirus 6
ccgataccggcaagatctgtcgtctggcaaactcgttttccaccttatgg

SEQ ID NO: 7561 - DNA, 50 bp, Human herpesvirus 6
ctgtgggtccctccccctcatctgttattcccttcccctctgccaccgat

SEQ ID NO: 7562 - DNA, 55 bp, Homo sapiens
actacattttaattaaagattaatgggcatattagaagtttctcaaagttaggct

SEQ ID NO: 7563 - DNA, 50 bp, Homo sapiens
aaaaggagtgagctatcatcagtgctgtgaaataaaagtctggtgtgcca

SEQ ID NO: 7564 - DNA, 50 bp, Homo sapiens
aaagccaccactgttcccagtcagcatatacaagctcttaatattctgtt

SEQ ID NO: 7565 - DNA, 50 bp, Homo sapiens
aaatgtgggataacgcgatgactgtgaccctggttggaaattaaacttgt

SEQ ID NO: 7566 - DNA, 50 bp, Homo sapiens
aacacagaaacatttgagcattgtatttctcgcatcccttctcgtgagcg

SEQ ID NO: 7567 - DNA, 50 bp, Homo sapiens
aacctatcaaagcctagcctaagggctgccatctctgtctaaattctagt

SEQ ID NO: 7568 - DNA, 50 bp, Homo sapiens
aactgcatggtatgaattcagagtgtgacttaagggtcaattcaaagcag

SEQ ID NO: 7569 - DNA, 50 bp, Homo sapiens
acagactttgttaatgtaggaaatctctccaagtggaaacgtgctaactt

SEQ ID NO: 7570 - DNA, 50 bp, Homo sapiens
acaggcaattcagtggactataataatagtggagggttgagatgtagagt

SEQ ID NO: 7571 - DNA, 50 bp, Homo sapiens
acaggtcacagtggatttcttttcaaactgacaatgtttaggttttaagc

SEQ ID NO: 7572 - DNA, 50 bp, Homo sapiens
acctcaagcagatgagattcaggtaattgaagaggcagatgaagaggaat

SEQ ID NO: 7573 - DNA, 50 bp, Homo sapiens
accttctacaccactggaaaataacatggaggtttagagccgtgcaaaat

SEQ ID NO: 7574 - DNA, 50 bp, Homo sapiens
actaaactctgaggcctgaagttctgtgatagaccttaaataagtgtcct

SEQ ID NO: 7575 - DNA, 50 bp, Homo sapiens
actggggtggtgatgttttcgttctgttttatttttctaactctgctgac

SEQ ID NO: 7576 - DNA, 50 bp, Homo sapiens
acttcatcataatttggagggaagctcttggagctgtgagttctccctgt

SEQ ID NO: 7577 - DNA, 50 bp, Homo sapiens
agaacgaggaagagaacacaaggaatgattcaagatccaccttgagagga

SEQ ID NO: 7578 - DNA, 50 bp, Homo sapiens
agagaataggctttctaagatgctgcgatcccgttctgctgcccgtaata

SEQ ID NO: 7579 - DNA, 50 bp, Homo sapiens
agcacaagccacgcttcaccaccaagaggcccaacaccttcttctaggtg

SEQ ID NO: 7580 - DNA, 50 bp, Homo sapiens
aggccaatcactgctgactaagaattcattatattggcttagtacacaga

SEQ ID NO: 7581 - DNA, 50 bp, Homo sapiens
agggaagatttctgtatacttgctggagaggaggaatgtgtatagttact

SEQ ID NO: 7582 - DNA, 50 bp, Homo sapiens
agttttaataccttaagctttttcaagacctaactgcagccgctttggga

SEQ ID NO: 7583 - DNA, 50 bp, Homo sapiens
atgtgctgtaaagtttcttctttccagtaaagactagccattgcattggc

SEQ ID NO: 7584 - DNA, 50 bp, Homo sapiens
attgtgggtggctctgtgggcgcatcaataaaagccgtccttgattttat

SEQ ID NO: 7585 - DNA, 50 bp, Homo sapiens
atttgagtgttgttggaccatgtgtgatcagactgctatctgaataaaat

SEQ ID NO: 7586 - DNA, 50 bp, Homo sapiens
caagcccacccagccgcacacaggcctagaggtaaccaataaagtattag

SEQ ID NO: 7587 - DNA, 50 bp, Homo sapiens
caccagagacaagcagagtaacaggatcagtgggtctaagtgtccgagac

SEQ ID NO: 7588 - DNA, 50 bp, Homo sapiens
caggaggtagggatctggctgagagggaataatctgagcaaaggtatgaa

SEQ ID NO: 7589 - DNA, 50 bp, Homo sapiens
cagtccctctcccaggaggaccctagaggcaattaaatgatgtcctgttc

SEQ ID NO: 7590 - DNA, 50 bp, Homo sapiens
catgagaagtatctgcaataaccccaagtcaacatttaggtttgtgtaca

SEQ ID NO: 7591 - DNA, 50 bp, Homo sapiens
catgttgagtaggaataaataaatctgatgctgcctcctgaggctgcggg

SEQ ID NO: 7592 - DNA, 50 bp, Homo sapiens
ccaccacctctgtggcattgaaatgagcacctccattaaagtctgaatca

SEQ ID NO: 7593 - DNA, 50 bp, Homo sapiens
ccatgccgcctcgttggattgtcggaatgtagacagaaatgtactgttct

SEQ ID NO: 7594 - DNA, 50 bp, Homo sapiens
cccaccgctttgtgagccgtgtcgtatgacctagtaaactttgtaccaat

SEQ ID NO: 7595 - DNA, 50 bp, Homo sapiens
cccacgggagactatttcacacaatttaatacaggaagtcgataatgagg

SEQ ID NO: 7596 - DNA, 50 bp, Homo sapiens
ccctccgtgaggaacacaatctcaatcgttgctgaatcctttcatatcct

SEQ ID NO: 7597 - DNA, 50 bp, Homo sapiens
ccgtgtctttccagccctaaaggaagggcagacccgtgtctttccatgcc

SEQ ID NO: 7598 - DNA, 50 bp, Homo sapiens
cctgaagcacttcacctggaattgatgtgtaggcttaaggagtatgtgac

SEQ ID NO: 7599 - DNA, 50 bp, Homo sapiens
cgcaggcaagagcactcatcaagatagatgtgaacaaaacccggaaaatc

SEQ ID NO: 7600 - DNA, 50 bp, Homo sapiens
cgctcaaaggtcactgagacttttgcctcacctaaagagaccaaggctca

SEQ ID NO: 7601 - DNA, 50 bp, Homo sapiens
cggcctcagtccctactctgctttgggatagtgtgagcttcattttgtac

SEQ ID NO: 7602 - DNA, 50 bp, Homo sapiens
ctagtgtgtgcttgccttgtccctcggggtagatgcttagctggcagtat

SEQ ID NO: 7603 - DNA, 50 bp, Homo sapiens
ctttcagattccctctggtctccgtccgaaacgtctacctcttcccaggc

SEQ ID NO: 7604 - DNA, 50 bp, Homo sapiens
gaaattcacaggccagggcacatcttttatttatttcattatgttggcca

SEQ ID NO: 7605 - DNA, 50 bp, Homo sapiens
gactccctcaacaccccaaaactctaaatgccacggtcatctgtttctat

SEQ ID NO: 7606 - DNA, 50 bp, Homo sapiens
gagcagccacaaaactgtaacctcaaggaaaccataaagcttggagtgcc

SEQ ID NO: 7607 - DNA, 50 bp, Homo sapiens
gcagcaaacagagggtcagtcacaggatgttctgacacaccattgtaact

SEQ ID NO: 7608 - DNA, 50 bp, Homo sapiens
gccaacaatgctgaccggtgcttatcctctaagccctgatccacaataaa

SEQ ID NO: 7609 - DNA, 50 bp, Homo sapiens
gccagtgtaatttctgtcaaccacggacgtttgccttcatgtgtagaatt

SEQ ID NO: 7610 - DNA, 50 bp, Homo sapiens
gcccaagcactagtagagatgcgcgatacaggtctagtttcggtaactgt

SEQ ID NO: 7611 - DNA, 50 bp, Homo sapiens
ggccagattttgactcccagattcctttacaaaacgcactcattcattca

SEQ ID NO: 7612 - DNA, 50 bp, Homo sapiens
gggactccccgcgtgataaattattaatgttccgcagtctcactctgaat

SEQ ID NO: 7613 - DNA, 50 bp, Homo sapiens
gggactgcatgggaagcacggaatatagggttagatgtgtgttatctgta

SEQ ID NO: 7614 - DNA, 50 bp, Homo sapiens
ggggttcgtgtctttggcatcaacaaatactgagggatgggttttgggac

SEQ ID NO: 7615 - DNA, 50 bp, Homo sapiens
gggtgacctgttctctagctgtgatcttaccacttcaaatgggtgtaatt

SEQ ID NO: 7616 - DNA, 50 bp, Homo sapiens
ggtgtgaacgggctgacttggtgaattgggcaactccttatagtgttgtg

SEQ ID NO: 7617 - DNA, 50 bp, Homo sapiens
gtaccacttgaatgatttcagtcaattttgaacccctttggaaagaggtg

SEQ ID NO: 7618 - DNA, 50 bp, Homo sapiens
gtgaaaccccgtctctgctaaaaatacaaaaattagctgggcgtggtggc

SEQ ID NO: 7619 - DNA, 50 bp, Homo sapiens
gttctctgggttgtgctttactccacgcatcaataaataattttgaaggc

SEQ ID NO: 7620 - DNA, 50 bp, Homo sapiens
tactgccaactgaccttataaccctctgcaccttcaaaaagattcatggt

SEQ ID NO: 7621 - DNA, 50 bp, Homo sapiens
tcaaacagtgacatctcttgggaaaatggacttaataggaatatgggact

SEQ ID NO: 7622 - DNA, 50 bp, Homo sapiens
tcacttcctctgaactgttactgcctgaatggagtcctggacgacattgg

SEQ ID NO: 7623 - DNA, 50 bp, Homo sapiens
tccacttaatagactctatgtgtgctgaatgttcctgtgtacatatgtgt

SEQ ID NO: 7624 - DNA, 50 bp, Homo sapiens
tcccgcagagtgcagagacaggaagctggagatgtctttataaagtcaca

SEQ ID NO: 7625 - DNA, 50 bp, Homo sapiens
tctaggaccctaggaagcttaactctgtcatcatctcaagtatctgcaca

SEQ ID NO: 7626 - DNA, 50 bp, Homo sapiens
tcttccgccatctcctctgataaacacgaggtgtctgccagcacccagag

SEQ ID NO: 7627 - DNA, 50 bp, Homo sapiens
tgatatgttgatcagccttatgtggaagaactgtgataaaaagaggagct

SEQ ID NO: 7628 - DNA, 50 bp, Homo sapiens
tgcagtatttttcaaacttctggtcgcaaacccattagtagtttgtgaaa

SEQ ID NO: 7629 - DNA, 50 bp, Homo sapiens
tgctgctcttgatcccacctttgctcctgacaaccctcattcaataaaga

SEQ ID NO: 7630 - DNA, 50 bp, Homo sapiens
tggtttgttcatggatgtattctaagagctgagaacagggcctggacaca

SEQ ID NO: 7631 - DNA, 50 bp, Homo sapiens
tgttctgaatgttggtagacccttcatagctttgttacaatgaaaccttg

SEQ ID NO: 7632 - DNA, 50 bp, Homo sapiens
tgttgatggatgaattttggcatgatgactgtactctcaataaaggctga

SEQ ID NO: 7633 - DNA, 50 bp, Homo sapiens
ttcatcctgtgagtgctggggaggaggagtagatacagactgagtgagag

SEQ ID NO: 7634 - DNA, 50 bp, Homo sapiens
ttcattttcctgggaagtcaaggttacatcttgcagaggttgttttgaga

SEQ ID NO: 7635 - DNA, 50 bp, Homo sapiens
ttctaagccgaaccaaatcctttgccttgaaagaacagccctaaagtggt

SEQ ID NO: 7636 - DNA, 50 bp, Homo sapiens
tttgtttgtttgtttcagatagggtctccctctgtcacccaggctgcagt

SEQ ID NO: 7637 - DNA, 50 bp, Homo sapiens
ttttgtaaatcacggacacctcaattagcaagaactgaggggagggcttt

SEQ ID NO: 7638 - DNA, 50 bp, Homo sapiens
cggtgtggaaaatgttgtcctttgagtggcaagaattagaaaaatcttca

SEQ ID NO: 7639 - DNA, 50 bp, Homo sapiens
ctgaaagctgaggatcggagcaagtttctggacgcacttatttccctcct

SEQ ID NO: 7640 - DNA, 50 bp, Homo sapiens
gttggcctcagccctgtgggtctgtctcatgctctccctgttcctctccc

SEQ ID NO: 7641 - DNA, 50 bp, Homo sapiens
tagccatacttagcctcagcaggagcctggcctgtaacttataaagtgca

SEQ ID NO: 7642 - DNA, 50 bp, Homo sapiens
tgagggctgtgctgacctttgagaggatttgaaattgcttcatattgtga

SEQ ID NO: 7643 - DNA, 50 bp, Homo sapiens
tgtgtaagaaaaggcccattacttttaaggtatgtgctgtcctattgagc

SEQ ID NO: 7644 - DNA, 50 bp, Homo sapiens
ttgttggtaggcacatcgtgtcaagtgaagtagttttataggtatgggtt

SEQ ID NO: 7645 - DNA, 50 bp, Homo sapiens
tttctagcttttccgtgtatctaaacacaatttgctacacaagtcactgt

SEQ ID NO: 7646 - DNA, 50 bp, Homo sapiens
actgtggcacatgttttgatcagaaaggtagttctctttgctctggtagt

SEQ ID NO: 7647 - DNA, 50 bp, Homo sapiens
catcttctgccctggtcccctttctcttgatgtggaaagtctgaatgcag

SEQ ID NO: 7648 - DNA, 50 bp, Homo sapiens
cgctctaatactgcattctgtttctccttttgtgccctgattgtaatcca

SEQ ID NO: 7649 - DNA, 50 bp, Homo sapiens
ctggagactggagaagtaattccaccaatgaaagaatttcctgatcaaca

SEQ ID NO: 7650 - DNA, 50 bp, Homo sapiens
tcagtgtttcgttattccatatcagtggcttttactgtcaaagattgtgt

SEQ ID NO: 7651 - DNA, 50 bp, Homo sapiens
tgcatgagagccctaggatttaaaatatgaaatggtggtctgctgtgtga

SEQ ID NO: 7652 - DNA, 50 bp, Homo sapiens
tgtgctaagcctgatgaaatgtgctccttcaatctccatgaaaccatcgt

SEQ ID NO: 7653 - DNA, 50 bp, Homo sapiens
aaatgatctccctttattaccctcccaaaggttaccagcgtttgaattta

SEQ ID NO: 7654 - DNA, 50 bp, Homo sapiens
acacactaatgtaaccattttatgaaggttgaagtggatttatgcaggca

SEQ ID NO: 7655 - DNA, 50 bp, Homo sapiens
atcaggagaatgtcaaagaagtcctttatgtggattgcccgagcttctct

SEQ ID NO: 7656 - DNA, 50 bp, Homo sapiens
attgtgccactgttttccagcctgggcaatacagtgagaccctgtctcaa

SEQ ID NO: 7657 - DNA, 50 bp, Homo sapiens
cgtcaaagtcaatcccaaaacagataagccctatgaggatgtcagcatca

SEQ ID NO: 7658 - DNA, 50 bp, Homo sapiens
acgacttgctcaagagtaaagattatactgctctgtacaggaagcttgca

SEQ ID NO: 7659 - DNA, 50 bp, Homo sapiens
tgttgaggaaaggaaaagggcatttgtctaaacatggattctgagttgta

SEQ ID NO: 7660 - DNA, 50 bp, Homo sapiens
gtggatgagtagggagtgggcgagacagggacgagatgagcagggtcaag

SEQ ID NO: 7661 - DNA, 50 bp, Homo sapiens
ggtgttcgtgttagtgccaagattgcttcgttgtagagagagttcgttcc

SEQ ID NO: 7662 - DNA, 50 bp, Homo sapiens
actagagtccaggtaatagtagtggagatatgtggagagacatgataggt

SEQ ID NO: 7663 - DNA, 50 bp, Homo sapiens
ttcctgtgtgagatttctcgccattcctcaattcaacaaatatgcctttt

SEQ ID NO: 7664 - DNA, 50 bp, Homo sapiens
tatactttgatccctcagcaagttgtcctcactgttgtgtgaacctgttt

SEQ ID NO: 7665 - DNA, 50 bp, Homo sapiens
tttcctgaatactttatgacaactgagtttgccgggtagagtggccgttt

SEQ ID NO: 7666 - DNA, 50 bp, Homo sapiens
aaactagaattccggtttcccaaggtggcttatgacaaccagaatccttt

SEQ ID NO: 7667 - DNA, 50 bp, Homo sapiens
ggcttcccgcctgtgcagtcatttgtatgtgttttatatattggagtgtt

SEQ ID NO: 7668 - DNA, 50 bp, Homo sapiens
acaaaatataaggtgtgactttggatcctgactcaaaccaaccagctgtt

SEQ ID NO: 7669 - DNA, 50 bp, Homo sapiens
tcaaaatccgttactctttccacaacaattgagggtaatggtgttcagtt

SEQ ID NO: 7670 - DNA, 50 bp, Homo sapiens
gccattccggcttctctatttgaaaacagttaccatattccccctcagtt

SEQ ID NO: 7671 - DNA, 50 bp, Homo sapiens
atttggtagagacggggtttcaccttattgcccaggccatcatgtatctt

SEQ ID NO: 7672 - DNA, 50 bp, Homo sapiens
tgtcatttgccctttcccccatatatgtagaattgggtctttttcaactt

SEQ ID NO: 7673 - DNA, 50 bp, Homo sapiens
acagggagagactacacacaagccaacctcaatctcatctttatgccatt

SEQ ID NO: 7674 - DNA, 50 bp, Homo sapiens
tcttctttttgatgtgaattactcttgaaatgccggagaagggacaaatt

SEQ ID NO: 7675 - DNA, 50 bp, Homo sapiens
agatagagtcatattctatttagcttgggacatggcaggtactcagttgt

SEQ ID NO: 7676 - DNA, 50 bp, Homo sapiens
agcctttttgggagtgagggtttatatgatgtctgattctgtaatactgt

SEQ ID NO: 7677 - DNA, 50 bp, Homo sapiens
gcagccctgagcctggaatagatactttttggtcttttggttgtagatgt

SEQ ID NO: 7678 - DNA, 50 bp, Homo sapiens
ccctccctatctttttatgggtaatttgattatacacggtgcttgaatgt

SEQ ID NO: 7679 - DNA, 50 bp, Homo sapiens
tatgtcttcttaccccagcacccctaatttaaaatacagatccctgaggt

SEQ ID NO: 7680 - DNA, 50 bp, Homo sapiens
aaaaccttgacagttcatttcaccaagcacctatcaggtatttggcaggt

SEQ ID NO: 7681 - DNA, 50 bp, Homo sapiens
agtgcccatgctgtttcagatgctcttctagctcctggagatacatcagt

SEQ ID NO: 7682 - DNA, 50 bp, Homo sapiens
tgagcttctgctagtaattccttcaggggatttcctccatggccgtaagt

SEQ ID NO: 7683 - DNA, 50 bp, Homo sapiens
gagggtgtctgctaatgatttccgaaaagttcttcaaaacactccgaagt

SEQ ID NO: 7684 - DNA, 50 bp, Homo sapiens
accagtgtgatgagttttgacaagagacaaaaggaaagggtgggagaagt

SEQ ID NO: 7685 - DNA, 50 bp, Homo sapiens
gctggttgttgcctttcaagacagccaactaccatttattcaacagaagt

SEQ ID NO: 7686 - DNA, 50 bp, Homo sapiens
agtctgtctattctcttctctttagctctgtctgttgctcaaattcaagt

SEQ ID NO: 7687 - DNA, 50 bp, Homo sapiens
gccaaggtgagtcaaaacactgctcttcagaaagcaattatttgaaaagt

SEQ ID NO: 7688 - DNA, 50 bp, Homo sapiens
cattgtccctcccgctgtgctctcaggcaataaatgatttgattatttct

SEQ ID NO: 7689 - DNA, 50 bp, Homo sapiens
ggtcagaaacaggcccacagagactctggagggttcttcctttgtgttct

SEQ ID NO: 7690 - DNA, 50 bp, Homo sapiens
ttcaactgctttggcactgccatgggtacctgaggataagagagatgtct

SEQ ID NO: 7691 - DNA, 50 bp, Homo sapiens
gggttgactaaatgcacatgggcttatctttacctcttccagaaatgtct

SEQ ID NO: 7692 - DNA, 50 bp, Homo sapiens
tgcatgaccagaaacactgcctgatacagtaagcagaggtagctgtctct

SEQ ID NO: 7693 - DNA, 50 bp, Homo sapiens
acctgccagccagcccacaactataaactgtgtgacacccaaatttatct

SEQ ID NO: 7694 - DNA, 50 bp, Homo sapiens
ggtttctgaggtgattctaatatgcagtcatggttaagaacctgtgatct

SEQ ID NO: 7695 - DNA, 50 bp, Homo sapiens
aagccttggaccagcttcccgtttctctcttgtctcctgccaaaagatct

SEQ ID NO: 7696 - DNA, 50 bp, Homo sapiens
acccaaaggatggtgtctcctgtcccagttgaaaaggtttctacctagct

SEQ ID NO: 7697 - DNA, 50 bp, Homo sapiens
tggttgaatacgcaggaacacccacagtacccagggactaataaatagct

SEQ ID NO: 7698 - DNA, 50 bp, Homo sapiens
ttagggcagtggagaatcagggtgtatctaataaattccttcatggagct

SEQ ID NO: 7699 - DNA, 50 bp, Homo sapiens
gcagatgtctgcgtcatggtttattactcctgtgttcgtttcaaggagct

SEQ ID NO: 7700 - DNA, 50 bp, Homo sapiens
tgtctgtatttggagtccagtagtacactgaaaataatcccgtaaaagct

SEQ ID NO: 7701 - DNA, 50 bp, Homo sapiens
ctcccttcccaccatacacacactcccagctcattttgattccttttcct

SEQ ID NO: 7702 - DNA, 50 bp, Homo sapiens
ggtgaaattgactgggttcctctcccacctctctttccgtagcaattcct

SEQ ID NO: 7703 - DNA, 50 bp, Homo sapiens
actaattcccgtgtctggccctgaacatgaagatataatggacgatccct

SEQ ID NO: 7704 - DNA, 50 bp, Homo sapiens
ttaaaggctcaaacctacctcagacactgctctacccatccccatcccct

SEQ ID NO: 7705 - DNA, 50 bp, Homo sapiens
ccctttgtgagaagaagcaggtttcctttcctatggattgatgtgaccct

SEQ ID NO: 7706 - DNA, 50 bp, Homo sapiens
ttctacccatcacacagattcttccacttaataaaatccatcacctacct

SEQ ID NO: 7707 - DNA, 50 bp, Homo sapiens
tcattactgttgtgaaggctcttcaagagagaaagatgaagctgaaacct

SEQ ID NO: 7708 - DNA, 50 bp, Homo sapiens
gctgtccgtgaaagcactctcaagtcaggaactgaactaagaactttact

SEQ ID NO: 7709 - DNA, 50 bp, Homo sapiens
ctcctgtaatcccagcactggagcttgcagtgagccaagatcatgccact

SEQ ID NO: 7710 - DNA, 50 bp, Homo sapiens
ttggtcaccacacctgggtgtctgaatgtcttgtccttctaaaggtaact

SEQ ID NO: 7711 - DNA, 50 bp, Homo sapiens
gcaacaattctttggaaagtgactctctagggtgcggagaatggtgtgat

SEQ ID NO: 7712 - DNA, 50 bp, Homo sapiens
tcatctctgtaggtcttcctaatcctatgcggagccaaatatagacggat

SEQ ID NO: 7713 - DNA, 50 bp, Homo sapiens
ctttgtatttcaaagaaagtagccccttggctctgatattagttgcagat

SEQ ID NO: 7714 - DNA, 50 bp, Homo sapiens; identical to SEQ ID NO: 5265

SEQ ID NO: 7715 - DNA, 50 bp, Homo sapiens
actgggatgagatgagattcaaggcacttttggagggtgtagctagccat

SEQ ID NO: 7716 - DNA, 50 bp, Homo sapiens
aggctgttgctgcacgggcttttcaaaagcgactcattatgaagaagaat

SEQ ID NO: 7717 - DNA, 50 bp, Homo sapiens
gcactccagcctgggcaacaagagcgaaactctgcctccaataaataaat

SEQ ID NO: 7718 - DNA, 50 bp, Homo sapiens
cgggcggtggcggctgcctgggagaagatgaatctttcatgagtgatttg

SEQ ID NO: 7719 - DNA, 50 bp, Homo sapiens
gatggaactcaaggtgctttacgctttcctcagtcttaccaggaggcttg

SEQ ID NO: 7720 - DNA, 50 bp, Homo sapiens
accaaccctatggacaacttgatcttgaacttctagctttcagacctgtg

SEQ ID NO: 7721 - DNA, 50 bp, Homo sapiens
aatgtagctgacattggagccaccgcccatagaagaaggctaaaactgtg

SEQ ID NO: 7722 - DNA, 50 bp, Homo sapiens
cttcactgacgatctgagacactaggcaggttggaaagggtggagtggtg

SEQ ID NO: 7723 - DNA, 50 bp, Homo sapiens
gcccctggtggttggaaaagtgttctgaatccaataaaaggaaagcggtg

SEQ ID NO: 7724 - DNA, 50 bp, Homo sapiens
caacagtggcaagagtagccagcccataggacggaatgaaaatcaaggtg

SEQ ID NO: 7725 - DNA, 50 bp, Homo sapiens
catccttagatgccagtcttcactttgggtattttcctgcctcctcagtg

SEQ ID NO: 7726 - DNA, 50 bp, Homo sapiens
accaacagtaccgttattgccaccacaagtaaaccagtccctcacttctg

SEQ ID NO: 7727 - DNA, 50 bp, Homo sapiens
aggctaaatcagagctttcctccccagataaaggaaattttccctccctg

SEQ ID NO: 7728 - DNA, 50 bp, Homo sapiens
aacttccagaggcaggagattagacagggatgacagttaaggggttactg

SEQ ID NO: 7729 - DNA, 50 bp, Homo sapiens
acctcttcgttgtattttacctttcacttacaaacaagctcatgccactg

SEQ ID NO: 7730 - DNA, 50 bp, Homo sapiens
gatcaaaacaaggtccttgactttttgcaggggcagcctggcaatcaatg

SEQ ID NO: 7731 - DNA, 50 bp, Homo sapiens
cctaaatgttgtccctcagagatgcacagatgtatatgggtaaggaaatg

SEQ ID NO: 7732 - DNA, 50 bp, Homo sapiens
ccaaccatagtcatgaagctgcttctgttcccaatgcaatcccattgtgg

SEQ ID NO: 7733 - DNA, 50 bp, Homo sapiens
gcttttcaatgcttccgaaactgagtgctaacaggggcaattagtgctgg

SEQ ID NO: 7734 - DNA, 50 bp, Homo sapiens
agttcttgtaacagttaaaactttcttgccagctctcaggttatcactgg

SEQ ID NO: 7735 - DNA, 50 bp, Homo sapiens
gtgtgtaaatgagtgtcagatcttttcttgaaaacaggtttggattgggg

SEQ ID NO: 7736 - DNA, 50 bp, Homo sapiens
agggtccacaaggagaatattttcttaaagtaactccctgatttgcgggg

SEQ ID NO: 7737 - DNA, 50 bp, Homo sapiens
gctcccctatgcctgtgtagcagaatctaaaagataatcatgtgaacggg

SEQ ID NO: 7738 - DNA, 50 bp, Homo sapiens
ttgtcttgtttcttttatctcccctatgtttcatcttagtgcaggcaggg

SEQ ID NO: 7739 - DNA, 50 bp, Homo sapiens
acagttgcctttgagattcctgtatttctgcatgaataaatccataaggg

SEQ ID NO: 7740 - DNA, 50 bp, Homo sapiens
gtccttggaaggtaacacttgtgattggaaccactcttcaagctgaacgg

SEQ ID NO: 7741 - DNA, 50 bp, Homo sapiens
attcattcattcattcaacaagcacttaaaaacaatgcctgtgtgccagg

SEQ ID NO: 7742 - DNA, 50 bp, Homo sapiens
cacacccagccccattcacaaaggactataaaatctacaccccagtcacg

SEQ ID NO: 7743 - DNA, 50 bp, Homo sapiens
ggcatagtagtgctaaacagaggtggaagtagtgaagggagttttgaacg

SEQ ID NO: 7744 - DNA, 50 bp, Homo sapiens
ctagtcctgcccccacctccccaagtattacccctcctaagtcctgctag

SEQ ID NO: 7745 - DNA, 50 bp, Homo sapiens
agataagcaggataaacaagacaggttggattgtgatcagctctatggag

SEQ ID NO: 7746 - DNA, 50 bp, Homo sapiens
gatggctaggacaagatgatttacaagagcgtggcgggagggacggcgag

SEQ ID NO: 7747 - DNA, 50 bp, Homo sapiens
ccgtgtctggattgtgtgtcttacttctaaaggtgcacatacttcataag

SEQ ID NO: 7748 - DNA, 50 bp, Homo sapiens
gtatctctgcacctcactactacccttcactccttggagacctgggcaag

SEQ ID NO: 7749 - DNA, 50 bp, Homo sapiens
aacacaccaccaaacattcttcccatccttcttcaccaaccagctacaag

SEQ ID NO: 7750 - DNA, 50 bp, Homo sapiens
acaattggagttggggctgtcaccacctgaagtgtgtcaaccacagaaag

SEQ ID NO: 7751 - DNA, 50 bp, Homo sapiens
ttagggcaaaagtcctagtggcggcagctttcttgtctagaccctggttc

SEQ ID NO: 7752 - DNA, 50 bp, Homo sapiens
agtgatgcttgccttttcgctttcctaaagatgtcatttgaaaacaagtc

SEQ ID NO: 7753 - DNA, 50 bp, Homo sapiens
cccagcttcattaatgtgaatggtggcagacacctctagctatagagctc

SEQ ID NO: 7754 - DNA, 50 bp, Homo sapiens
gagccaagattgggccactgcactccagcctgggtgacagagtgagactc

SEQ ID NO: 7755 - DNA, 50 bp, Homo sapiens
gagccgagattgcatcactgcactccagcctggtcaacagagcgagactc

SEQ ID NO: 7756 - DNA, 50 bp, Homo sapiens
ttcagtcatgcagcaacatccgcttaatgcctcctaagtgcagaacactc

SEQ ID NO: 7757 - DNA, 50 bp, Homo sapiens
ggtcctcttctctctactctccctagtaactaaccaccaaagcctaaatc

SEQ ID NO: 7758 - DNA, 50 bp, Homo sapiens
ttgtttgtttgtttatttatttattttgaggcagcgtcttgctctgttgc

SEQ ID NO: 7759 - DNA, 50 bp, Homo sapiens
tgccatctttacatctaatcaagaggtagagcttcccctggtgttcctgc

SEQ ID NO: 7760 - DNA, 50 bp, Homo sapiens
tgctctgctcttcccaaatcaaggaatgtagatcttgctaacagaactgc

SEQ ID NO: 7761 - DNA, 50 bp, Homo sapiens
tggcaccaacttacacttccagaagagagtggttcaggaaattactatgc

SEQ ID NO: 7762 - DNA, 50 bp, Homo sapiens
aactttgggaagtgagactctgtcttgggtttttgataataaatgtgggc

SEQ ID NO: 7763 - DNA, 50 bp, Homo sapiens
ccgagaaagtacggctggagcggactggggagacggaaatattgagtcgc

SEQ ID NO: 7764 - DNA, 50 bp, Homo sapiens
cgaagaaagaattggatgcagaattgttgcctaacctgggtgacaagagc

SEQ ID NO: 7765 - DNA, 50 bp, Homo sapiens
agtgcctgtgattccacccccttacctcccactcaagtgacaatgtaagc

SEQ ID NO: 7766 - DNA, 50 bp, Homo sapiens
agaaagttaggagtcggcaaccttaaggaggagtttcctatcatctctcc

SEQ ID NO: 7767 - DNA, 50 bp, Homo sapiens
tgtcacaaagatgaagcaaggtggctcagggaacgtgctcagaaacctcc

SEQ ID NO: 7768 - DNA, 50 bp, Homo sapiens
gcaaagtgaaagttttccctttggccctaaaatatgaaagcaaagcatcc

SEQ ID NO: 7769 - DNA, 50 bp, Homo sapiens
ccctgtccatcttttcctgttcctatccagccttccctctcctttttgcc

SEQ ID NO: 7770 - DNA, 50 bp, Homo sapiens
ccacggagggctccccatctaaagggagtttaataaacaaaggaatggcc

SEQ ID NO: 7771 - DNA, 50 bp, Homo sapiens
caattggtacattctcggcaaacccttgcccacaatttcctcaggaagcc

SEQ ID NO: 7772 - DNA, 50 bp, Homo sapiens
agggtgtccctgtgatttttaaattcactatctagctgtccctatccccc

SEQ ID NO: 7773 - DNA, 50 bp, Homo sapiens
cttatattatgttttctctgtgacaagcacctcacctcccaacccacccc

SEQ ID NO: 7774 - DNA, 50 bp, Homo sapiens
gagaattcaaattaaatgcagagtcctaggcccaccctggcataccaccc

SEQ ID NO: 7775 - DNA, 50 bp, Homo sapiens
acaaccaatgcctcacacttaagctcctagaagtcactagggaccagacc

SEQ ID NO: 7776 - DNA, 50 bp, Homo sapiens
gccctcaccagaattcaatcatgctggcaccttatcttggactttcaacc

SEQ ID NO: 7777 - DNA, 50 bp, Homo sapiens
agggtaagagttccagacctgactggacaataaagtgagactgtctctac

SEQ ID NO: 7778 - DNA, 50 bp, Homo sapiens
ctccgtctgccgcctccgtagccacagcgactttggaagtgatatttgac

SEQ ID NO: 7779 - DNA, 50 bp, Homo sapiens
ccctggagaaggagggtgatttattttcaactttctgatttaccaccgac

SEQ ID NO: 7780 - DNA, 50 bp, Homo sapiens
gattgtttgagcctgggagttccacaccagcctgggctacatagggagac

SEQ ID NO: 7781 - DNA, 50 bp, Homo sapiens
ctgctctagactgagcacagccactgacaggtgaccttcagaatcctcac

SEQ ID NO: 7782 - DNA, 50 bp, Homo sapiens
acccctgctttactgtgacagacatatagtttgtcatacataaaacccac

SEQ ID NO: 7783 - DNA, 50 bp, Homo sapiens
acctaacagaaatttggattcgggttgtctaaatacaccctggtgggtta

SEQ ID NO: 7784 - DNA, 50 bp, Homo sapiens
gcctttcccaccaacagtttatgtgattccctgccctacccttaccatta

SEQ ID NO: 7785 - DNA, 50 bp, Homo sapiens
tcccattgcatgtcccgtatattgaaagctgcctctacttctctctggta

SEQ ID NO: 7786 - DNA, 50 bp, Homo sapiens
ggcaggggatgaaccagataatttccagcccttcttggtagctcttcgta

SEQ ID NO: 7787 - DNA, 50 bp, Homo sapiens
gcttaggagtttgggaccagcctgggtaacatagtgaaaccctgtctcta

SEQ ID NO: 7788 - DNA, 50 bp, Homo sapiens
ttgcagctattttcaagttgtaagaaatgaacttgcaacacatagggcta

SEQ ID NO: 7789 - DNA, 50 bp, Homo sapiens
tctcttgccacagggatttcctccaagctggaatcaccatttccttccta

SEQ ID NO: 7790 - DNA, 50 bp, Homo sapiens
cccacccaccagtaggttgtgattcaactgaaccatttcaggagcaccta

SEQ ID NO: 7791 - DNA, 50 bp, Homo sapiens
gaacccagctaagccacacccagattctgacccagggatactctgaaata

SEQ ID NO: 7792 - DNA, 50 bp, Homo sapiens
gtgtgtgctggcgtgccttataggtgtgcgtgtttccctgtcagttttga

SEQ ID NO: 7793 - DNA, 50 bp, Homo sapiens
aggaaaactcagaaataatttctgccccctggattctctaagatttgtga

SEQ ID NO: 7794 - DNA, 50 bp, Homo sapiens
gtggaaagaatcctacaacgaacactattaaagtctgcacctagatctga

SEQ ID NO: 7795 - DNA, 50 bp, Homo sapiens
ggcctaggttccagcattcagtcatcaagtcttgttacagaaataaatga

SEQ ID NO: 7796 - DNA, 50 bp, Homo sapiens
ccccatttggagtctagtcaaaacagcagcttctttgagttaccattgga

SEQ ID NO: 7797 - DNA, 50 bp, Homo sapiens
aaggcttgtaactgtaggcccttgtactacactgtgctatacctggtaga

SEQ ID NO: 7798 - DNA, 50 bp, Homo sapiens
cactttgggaggcagaggtgagcagatcacttgaggccaggagtttgaga

SEQ ID NO: 7799 - DNA, 50 bp, Homo sapiens
ggatcacttgaagccagcagtttgagaccagcctgggcaataaaatgaga

SEQ ID NO: 7800 - DNA, 50 bp, Homo sapiens
tcagttgtgatgggatttcttgatggatgagatgtgtcgtgtgacagaga

SEQ ID NO: 7801 - DNA, 50 bp, Homo sapiens
cctcctagaactggaaccaagactgctccatcagagttaaaggtgtaaga

SEQ ID NO: 7802 - DNA, 50 bp, Homo sapiens
gctcacccttgcacctccttcccaaatctgctgtcacattttctcaaaga

SEQ ID NO: 7803 - DNA, 50 bp, Homo sapiens
ttcctgtctccatgttgtggtcaagattgccatttgcttcctgagtttca

SEQ ID NO: 7804 - DNA, 50 bp, Homo sapiens
ctggttctagtgcagtctcctcactttcctggtgtttggtttatctttca

SEQ ID NO: 7805 - DNA, 50 bp, Homo sapiens
tgacatgattacctgactgatgtttctcctccattagactgaatgcttca

SEQ ID NO: 7806 - DNA, 50 bp, Homo sapiens
tggcaaaaagcctaacactgactcatcccattctatcagcacaaacttca

SEQ ID NO: 7807 - DNA, 50 bp, Homo sapiens
gtttacaagggatactagttcctggagggacgaaggaggctctgtttgca

SEQ ID NO: 7808 - DNA, 50 bp, Homo sapiens
tcctcaactcggagattcctgtatggagagaatcaatttctatatttgca

SEQ ID NO: 7809 - DNA, 50 bp, Homo sapiens
acatttcttaggtgtgtagtggtgaaggaaaatagtggaagatgtctgca

SEQ ID NO: 7810 - DNA, 50 bp, Homo sapiens
tcaggaggcttgaaaagactcaaggtttctacactatgggaaataaggca

SEQ ID NO: 7811 - DNA, 50 bp, Homo sapiens
gttttcacttgtgatactaactattgtttttctcccccatgccaagagca

SEQ ID NO: 7812 - DNA, 50 bp, Homo sapiens
agccaagggagcatattattctcttattttaaacctctccgtaggcagca

SEQ ID NO: 7813 - DNA, 50 bp, Homo sapiens
agaaggacccctggttgagaaccacggttgtatagaaaggaattgaagca

SEQ ID NO: 7814 - DNA, 50 bp, Homo sapiens
ttgactgccatagccaagagttaatatagttgcgttttcttaaggaagca

SEQ ID NO: 7815 - DNA, 50 bp, Homo sapiens
cttactgtgcttttaggttttgttgctttctgtctgtatgctatgttcca

SEQ ID NO: 7816 - DNA, 50 bp, Homo sapiens
tgcagttaggagtgtggacactctgcccatctccattgaattaaattcca

SEQ ID NO: 7817 - DNA, 50 bp, Homo sapiens
acttgggttctatccccacgataacttgttatgtatatgccaatatccca

SEQ ID NO: 7818 - DNA, 50 bp, Homo sapiens
agctagaaaatgtccctttttcttctttggaggtctttaaccaaggccca

SEQ ID NO: 7819 - DNA, 50 bp, Homo sapiens
atcaccaatcttatttagcactgtggatgccgttttgcaaatgtcaccca

SEQ ID NO: 7820 - DNA, 50 bp, Homo sapiens
tgacttaaggttggaatatctcctactactcccctgtcctccttggacca

SEQ ID NO: 7821 - DNA, 50 bp, Homo sapiens
tgtggtttgcaatggtttactgatgagacagcaaaaatgagacaggacca

SEQ ID NO: 7822 - DNA, 50 bp, Homo sapiens
tggcgagccagtctctggatgggattctgatcaacagaagttctcataca

SEQ ID NO: 7823 - DNA, 50 bp, Homo sapiens
tgcccatcctttgctgtttttctctttcagtcatggcctatttggagaca

SEQ ID NO: 7824 - DNA, 50 bp, Homo sapiens
ctcaaccttggccctaaactaacagtgacagggagttccccagcctcaca

SEQ ID NO: 7825 - DNA, 50 bp, Homo sapiens
tcctgaccgttgacagagagcttttacagaagtcttaggcagtacacaca

SEQ ID NO: 7826 - DNA, 50 bp, Homo sapiens
agtgtgtggcacccagggatcactgtatgagaatttcctgaacaacaaca

SEQ ID NO: 7827 - DNA, 50 bp, Homo sapiens
gctgtaagtcccttccttactcatcttccctctcaaatacaacaacaaca

SEQ ID NO: 7828 - DNA, 50 bp, Homo sapiens
gccagttggcaccatttatgaaacacaccaccttgtaaccactgaattaa

SEQ ID NO: 7829 - DNA, 50 bp, Homo sapiens
tcaacctagcacagtgcctggctgataggtgttgaatatttccactctaa

SEQ ID NO: 7830 - DNA, 50 bp, Homo sapiens
gcaaccctctgcccctgcaaagagatattgtgacaaagatattcactgaa

SEQ ID NO: 7831 - DNA, 50 bp, Homo sapiens
taacattcctggcacagtccctggcatagggtagataataaatggtggaa

SEQ ID NO: 7832 - DNA, 50 bp, Homo sapiens
tctctaaccatcaaggaaggtcaagggccatgtatctcttttagggagaa

SEQ ID NO: 7833 - DNA, 50 bp, Homo sapiens
ttccacaaactcaggtgtgcaagaaacaatgcattactttattttcagaa

SEQ ID NO: 7834 - DNA, 50 bp, Homo sapiens
caggagtttgagaccagcctgggcaacatagtaagtctccatctcttcaa

SEQ ID NO: 7835 - DNA, 50 bp, Homo sapiens
tccctagtcctggagactcgggaactaaaacaatcaattcccctgagcaa

SEQ ID NO: 7836 - DNA, 50 bp, Homo sapiens
tcctcttcattggagacccctccctgtcacagcacaatgtgggtaataaa

SEQ ID NO: 7837 - DNA, 50 bp, Homo sapiens
cagaacaaggcccacagtgtgaaaggtgctgctgaacaaagataaataaa

SEQ ID NO: 7838 - DNA, 50 bp, Homo sapiens
gagtcagcaacactggtcctcttgccttggttgatgcttttgaactgaaa

SEQ ID NO: 7839 - DNA, 50 bp, Homo sapiens
taaggatgtatccctatgggcaggaaacccaattctaagaaacttacaaa

SEQ ID NO: 7840 - DNA, 50 bp, Homo sapiens
gccactgcactccagcctgggcaacagagcgagaccttgactctttaaaa

SEQ ID NO: 7841 - DNA, 50 bp, Homo sapiens
cacaacacccaaaaggctgcattgcataacatgtatttgttgaatgaaaa

SEQ ID NO: 7842 - DNA, 50 bp, Homo sapiens
ggggtccttgctcacagagctcccaagatggtggtgggccacttccaaaa

SEQ ID NO: 7843 - DNA, 50 bp, Homo sapiens
tccctctataggtaaaagacctgtttgtctgaaatgtgtggaacctgtct

SEQ ID NO: 7844 - DNA, 50 bp, Homo sapiens
gctgccgtgtcttttggcattttcagcatgactatatgtttttgtaatgt

SEQ ID NO: 7845 - DNA, 50 bp, Homo sapiens
ccgaaggcccgtgtggcgcttctcctattctgtagagtggtagtttgttt

SEQ ID NO: 7846 - DNA, 50 bp, Homo sapiens
aaagaggtaaacgcaagttctctcttgtaggtcgggctacaggtgacttt

SEQ ID NO: 7847 - DNA, 50 bp, Homo sapiens
tggttctcagcctgggtgaacagagaaggggtctaatttggtcttttgtt

SEQ ID NO: 7848 - DNA, 50 bp, Homo sapiens
tgttcttggcaccctgcactgtcaggctatatcatttctgtttgtttctt

SEQ ID NO: 7849 - DNA, 50 bp, Homo sapiens
tctcattttcttttcctagctgtgatgcaaagtgtcagtggtcccatctt

SEQ ID NO: 7850 - DNA, 50 bp, Homo sapiens
tgtccaaccttccttttgctacaaacaaagaatgcctagggattcaactt

SEQ ID NO: 7851 - DNA, 50 bp, Homo sapiens
caagtggccttggtgtttaaatcttgccctaaattgtaactcacatgatt

SEQ ID NO: 7852 - DNA, 50 bp, Homo sapiens
accaaccagtggtgtgctggagctgtctcatactatcttgagagtccatt

SEQ ID NO: 7853 - DNA, 50 bp, Homo sapiens
agcacttgctttgttccagacattgtccttagctcctttcttgtgtaatt

SEQ ID NO: 7854 - DNA, 50 bp, Homo sapiens
tgcagcaaaaattgaatttcataggccattcagtgttctctgcgataatt

SEQ ID NO: 7855 - DNA, 50 bp, Homo sapiens
ccaggaatggaaatacgccaacccaggttaggcacctctattgcagaatt

SEQ ID NO: 7856 - DNA, 50 bp, Homo sapiens
aggaaattggttgaagtcgtttttctcttgttagtctcatgttaagctgt

SEQ ID NO: 7857 - DNA, 50 bp, Homo sapiens
tcgcctggggagaatttaaaatctaagtcgctggaagtccctttgtatgt

SEQ ID NO: 7858 - DNA, 50 bp, Homo sapiens
acctgtaggaagggtttgtgaatattctgttgctctgaattattagcggt

SEQ ID NO: 7859 - DNA, 50 bp, Homo sapiens
tgagaggatcttgagacattcttgtgttatttgccctctatgttttaggt

SEQ ID NO: 7860 - DNA, 50 bp, Homo sapiens
tcccaagcatgagacaagtaccaccagtggttcaggagatgattttaggt

SEQ ID NO: 7861 - DNA, 50 bp, Homo sapiens
acaagacagcagccttcccgaaatgtcactactaagaattattcagaggt

SEQ ID NO: 7862 - DNA, 50 bp, Homo sapiens
gctgcccaaacttccatttatttaccctccaaacatcacttccttcctct

SEQ ID NO: 7863 - DNA, 50 bp, Homo sapiens
acatttgccaatgcacttgatgtaaagttgttgaggatgttgactctcct

SEQ ID NO: 7864 - DNA, 50 bp, Homo sapiens
tcccccttcctaacaccaatttgggaacatcactacttgtatattatcct

SEQ ID NO: 7865 - DNA, 50 bp, Homo sapiens
tcaagacccttagagtaagttaactcccaaggaaatgtagttagttccct

SEQ ID NO: 7866 - DNA, 50 bp, Homo sapiens
aacccacaatccaactcccttgatgaggatgatcattaacaacaatcact

SEQ ID NO: 7867 - DNA, 50 bp, Homo sapiens
tttgaagcctctggtacttccccttcccaaacccagtcacaggaaacact

SEQ ID NO: 7868 - DNA, 50 bp, Homo sapiens
ttggaggttaacagtattcctttgagtggtgtgattaaaggtgcttttat

SEQ ID NO: 7869 - DNA, 50 bp, Homo sapiens
ccaacctccagaactgcctatctaactcatctgtggtgatggaatgctat

SEQ ID NO: 7870 - DNA, 50 bp, Homo sapiens
agtggctctctgctgttagcatggttactaatcttttggttacttttcat

SEQ ID NO: 7871 - DNA, 50 bp, Homo sapiens
tgacctcagtgtctacttcagcagaacctgtgggtatatgcctacctcat

SEQ ID NO: 7872 - DNA, 50 bp, Homo sapiens
aaggagaactgtcaactgaatctcaaatgcagtcaaatgaagagaggcat

SEQ ID NO: 7873 - DNA, 50 bp, Homo sapiens
ttcaagtcattataggtttgggcatacagggttaaccttgtgatgtacat

SEQ ID NO: 7874 - DNA, 50 bp, Homo sapiens
agcagaacaacatgtgtttgacacttttccttctctgtaatgaggtacat

SEQ ID NO: 7875 - DNA, 50 bp, Homo sapiens
tgcctgtgtgggtcaaaggaatcatctatgctaatgtatttgagccaaat

SEQ ID NO: 7876 - DNA, 50 bp, Homo sapiens
accgaaagcagcattttcaatgtttaattaaatcgatgcaggaaattgtg

SEQ ID NO: 7877 - DNA, 50 bp, Homo sapiens
gtccctggcccttcactcttcgtccaggctctctgacctctttccctctg

SEQ ID NO: 7878 - DNA, 50 bp, Homo sapiens
tgtccgctgttttacctcactgctcctgtttatgcccttaacttctgctg

SEQ ID NO: 7879 - DNA, 50 bp, Homo sapiens
gcacaagacctcacttggaacaagtaccaggcagaagagagcattacctg

SEQ ID NO: 7880 - DNA, 50 bp, Homo sapiens
tttcatatcttggcagttggatgcggtaagagccacagagaaaccacctg

SEQ ID NO: 7881 - DNA, 50 bp, Homo sapiens
aggacccttttcccatatttctggctatatacaaggatatccagacactg

SEQ ID NO: 7882 - DNA, 50 bp, Homo sapiens
accaggcctagaatttaggttctaggtgtaaactattggcctatcagatg

SEQ ID NO: 7883 - DNA, 50 bp, Homo sapiens
gtgcattttagcaacagacttccaggtttccagcgcgggccaggaagggg

SEQ ID NO: 7884 - DNA, 50 bp, Homo sapiens
ctgtcatgcaccacctcatcccctccttcagggccagggacagtccctag

SEQ ID NO: 7885 - DNA, 50 bp, Homo sapiens
agaggaggagggggtagaatgaatttcatttaaagctcaacctagttcag

SEQ ID NO: 7886 - DNA, 50 bp, Homo sapiens
cagtctcccagctttcttggcctcctctgccaactggatgcaaggctcag

SEQ ID NO: 7887 - DNA, 50 bp, Homo sapiens
tggagagaaggttcgggaagacgagggggctgggaggtttggaaagacag

SEQ ID NO: 7888 - DNA, 50 bp, Homo sapiens
ctgaaatgggggaaggtgggttatgacaaagttcatggagaggcctgaag

SEQ ID NO: 7889 - DNA, 50 bp, Homo sapiens
taaagcggtacgggattccgcaccctactccagcaagaaagagcctgaag

SEQ ID NO: 7890 - DNA, 50 bp, Homo sapiens
agcattcattcctccaaacacactcccagggttaggtctcttacctctgc

SEQ ID NO: 7891 - DNA, 50 bp, Homo sapiens
ggtgttgaatatttatacggattggcatcataagataccgcgatacctgc

SEQ ID NO: 7892 - DNA, 50 bp, Homo sapiens
accttagtctaactgccttctgtaaagtgggttgctatagtctttaagcc

SEQ ID NO: 7893 - DNA, 50 bp, Homo sapiens
tgaggtttggatggtggcaggtaaaacagaaaggcaagatgtcatctgac

SEQ ID NO: 7894 - DNA, 50 bp, Homo sapiens
tggagctgctacataattatttcaggtctcaaagcttccaagaagtggac

SEQ ID NO: 7895 - DNA, 50 bp, Homo sapiens
agacggaacctgagatgttggatgttgttgatcttagcaaacagacttta

SEQ ID NO: 7896 - DNA, 50 bp, Homo sapiens
agatctgtaatctttggcaaatggaactcacctgcaacgatacctactta

SEQ ID NO: 7897 - DNA, 50 bp, Homo sapiens
gaggacttccattccccatttcccgcatacctgctgttctgtctgaatta

SEQ ID NO: 7898 - DNA, 50 bp, Homo sapiens
agctcacacctgttccttcatgggtcagttcctttcattttcacttttga

SEQ ID NO: 7899 - DNA, 50 bp, Homo sapiens
agctgctgcttctctttcagttgcaaatgcaaacctgttataatctttga

SEQ ID NO: 7900 - DNA, 50 bp, Homo sapiens
tcaatatctgtgtgtcttttcatgagtggctgttacttgtgaagaattga

SEQ ID NO: 7901 - DNA, 50 bp, Homo sapiens
tgagtggactgaggaatgaatagaaaacgtggatatatgtagaaagctga

SEQ ID NO: 7902 - DNA, 50 bp, Homo sapiens
accagcccctgggaatgttatgagcaaatgatactccatgagtaaaatga

SEQ ID NO: 7903 - DNA, 50 bp, Homo sapiens
tcgtgtgagtgtgagagacatgttcattgtgaaaagatactcctagtgga

SEQ ID NO: 7904 - DNA, 50 bp, Homo sapiens
tttgtcaaatgcctgttcaccatctgtggaagtcattatatgattcagga

SEQ ID NO: 7905 - DNA, 50 bp, Homo sapiens
acacttttcttctaaggagagctttcttaggcatttcaaagaactttcga

SEQ ID NO: 7906 - DNA, 50 bp, Homo sapiens
accaaatgagtaccatctgttgaacacagggtggcgatccaagtgtttca

SEQ ID NO: 7907 - DNA, 50 bp, Homo sapiens
acctgacttccacgataaaatggagatgagtgcaggggtgagtgtatagt

SEQ ID NO: 7908 - DNA, 50 bp, Homo sapiens
tgcagatttatactcctgacgtgtctcattcacagctaaataataggcca

SEQ ID NO: 7909 - DNA, 50 bp, Homo sapiens
accctcgccctttccctccggttcagtacctattgtttctcctttcaaat

SEQ ID NO: 7910 - DNA, 50 bp, Homo sapiens
aagaggaaatggcagaattaaaagcagaaacaagaagatggacatggatt

SEQ ID NO: 7911 - DNA, 50 bp, Homo sapiens
aagagtgtttgagtgcttgtcatcaggtgttttccttaataagtagggat

SEQ ID NO: 7912 - DNA, 50 bp, Homo sapiens; identical to SEQ ID NO: 2584

SEQ ID NO: 7913 - DNA, 50 bp, Homo sapiens
ttccttggattcatttcacttggctagaaattacactgtgctcaatgcct

SEQ ID NO: 7914 - DNA, 50 bp, Homo sapiens
aggtctctgccacctccttctctgtgagctgtcagtctaggttattctct

SEQ ID NO: 7915 - DNA, 50 bp, Homo sapiens
gaataggagggacatggaaccatttgcctctggctgtgtcacagggtgag

SEQ ID NO: 7916 - DNA, 50 bp, Homo sapiens; identical to SEQ ID NO: 507

SEQ ID NO: 7917 - DNA, 50 bp, Homo sapiens
tttcactttcacacttcatctcattcctgttgtcactttccccgaaacga

SEQ ID NO: 7918 - DNA, 50 bp, Homo sapiens
tctggatcaatagcttcccctctagggtctactgatgagtcaaatctaaa

SEQ ID NO: 7919 - DNA, 50 bp, Homo sapiens
tttatctactgtgtgttgtggtggcctgttggaggcaaatagatcagatt

SEQ ID NO: 7920 - DNA, 50 bp, Homo sapiens
gacatttttgtaggatgcctgacgaggtgtagccttttatcttgtttccg

SEQ ID NO: 7921 - DNA, 50 bp, Homo sapiens
cccagtttgtggaagcacaggcaagagtgttcttttctggtgattctcca

SEQ ID NO: 7922 - DNA, 50 bp, Homo sapiens
tgttccttttcctgactcctccttgcaaacaaaatgatagttgacacttt

SEQ ID NO: 7923 - DNA, 50 bp, Homo sapiens
gtgacttgtacattcagcaatagcatttgagcaagttttatcagcaagca

SEQ ID NO: 7924 - DNA, 50 bp, Homo sapiens
ttgctatcgacattcccgtataaagagagagacatatcacgctgctgtca

SEQ ID NO: 7925 - DNA, 50 bp, Homo sapiens; identical to SEQ ID NO: 618

SEQ ID NO: 7926 - DNA, 50 bp, Homo sapiens; identical to SEQ ID NO: 7197

SEQ ID NO: 7927 - DNA, 50 bp, Homo sapiens; identical to SEQ ID NO: 619

SEQ ID NO: 7928 - DNA, 50 bp, Homo sapiens
tgtgattaggttgttttcctgtcatttttgagagactaaaattgtggggg

SEQ ID NO: 7929 - DNA, 50 bp, Homo sapiens; identical to SEQ ID NO: 7260

SEQ ID NO: 7930 - DNA, 50 bp, Homo sapiens
aacaagatgagaacagataaagattgtgtggtgttttggatttggagaga

SEQ ID NO: 7931 - DNA, 50 bp, Homo sapiens
tgtagctcccacaaggtaaacttcattggtaagattgcactgttctgatt

SEQ ID NO: 7932 - DNA, 50 bp, Homo sapiens
tcactcccccatttcacttctttgtcagagaatagttcttgttcatactg

SEQ ID NO: 7933 - DNA, 50 bp, Homo sapiens
tgggagtgacaaacattctctcatcctacttagcctacctagatttctca

SEQ ID NO: 7934 - DNA, 50 bp, Homo sapiens; identical to SEQ ID NO: 648

SEQ ID NO: 7935 - DNA, 50 bp, Homo sapiens
ccccagcctaaagcagggatcagtcttttcttgtggaataaatccttgga

SEQ ID NO: 7936 - DNA, 50 bp, Homo sapiens
tgtggtaatgcctgttttcatctgtaaatagttaagtatgtacacgaggc

SEQ ID NO: 7937 - DNA, 50 bp, Homo sapiens
agatgcttagtccctcatgcaaatcaattactggtccaaaagattgctga

SEQ ID NO: 7938 - DNA, 50 bp, Homo sapiens
aaaactgctcttctgctctagtaccatgcttagtgcaaatgattatttct

SEQ ID NO: 7939 - DNA, 50 bp, Homo sapiens
agctattaggatcttcaacccaggtaacaggaataattctgtggtttcat

SEQ ID NO: 7940 - DNA, 50 bp, Homo sapiens
tcctgcgtctatccatgtggaatgctggacaataaagcgagtgctgccca

SEQ ID NO: 7941 - DNA, 50 bp, Homo sapiens; identical to SEQ ID NO: 4805

SEQ ID NO: 7942 - DNA, 50 bp, Homo sapiens
actgctttgactggtgggtctctagaagcaaaactgagtgataactcatg

SEQ ID NO: 7943 - DNA, 50 bp, Homo sapiens
ggcattgtctctgtttcccagtggggtggacagtatatcagatggtcaga

SEQ ID NO: 7944 - DNA, 50 bp, Homo sapiens
ccctgggctaccatctgcatggggctggggtcctcctgtgctatttgtac

SEQ ID NO: 7945 - DNA, 50 bp, Homo sapiens; identical to SEQ ID NO: 727

SEQ ID NO: 7946 - DNA, 50 bp, Homo sapiens
tcttggcagccatcctttttaagagtaagttggttacttcaaaaagagca

SEQ ID NO: 7947 - DNA, 50 bp, Homo sapiens
agctaaagagagggaacctcatctaagtaacatttgcacatgatacagca

SEQ ID NO: 7948 - DNA, 50 bp, Homo sapiens
gctgagtgctggccctctgcgtcttccttattaaccttgaatcctcatta

SEQ ID NO: 7949 - DNA, 50 bp, Homo sapiens; identical to SEQ ID NO: 768

SEQ ID NO: 7950 - DNA, 50 bp, Homo sapiens
tccgggccaagaatttttatccatgaagactttcctacttttctcggtgt

SEQ ID NO: 7951 - DNA, 50 bp, Homo sapiens
gcagagttcattgttgccccttaacagtttttcctgagtttactgaagaa

SEQ ID NO: 7952 - DNA, 50 bp, Homo sapiens
ttatcaagcagagacctttgttgggaggcggtttgggagaacacatttct

SEQ ID NO: 7953 - DNA, 50 bp, Homo sapiens
gggtatgctgcctctgtaaattcatgtattcaaaggaaaagacaccttgc

SEQ ID NO: 7954 - DNA, 50 bp, Homo sapiens
ttgtctgccccacaatcaagaatgtatgtgtaaagtgtgaataaatctca

SEQ ID NO: 7955 - DNA, 50 bp, Homo sapiens; identical to SEQ ID NO: 2677

SEQ ID NO: 7956 - DNA, 50 bp, Homo sapiens
agcagtttgtgatatagcagaggtttaaatgtaccctccccttttatgca

SEQ ID NO: 7957 - DNA, 50 bp, Homo sapiens
tgatgctgcccattccactgaagttctgaaatctttcgtcatgtaaataa

SEQ ID NO: 7958 - DNA, 50 bp, Homo sapiens; identical to SEQ ID NO: 2256

SEQ ID NO: 7959 - DNA, 50 bp, Homo sapiens; identical to SEQ ID NO: 864

SEQ ID NO: 7960 - DNA, 50 bp, Homo sapiens
gccaggctggttccgcatggtgatctccgtcttgtatgtctgaatgttgg

SEQ ID NO: 7961 - DNA, 50 bp, Homo sapiens
ctatttccaaggcccctccctgtttccccagcaattaaaacggactcatc

SEQ ID NO: 7962 - DNA, 50 bp, Homo sapiens
aaagtgccagaatgactcttctgtgcattcttcttaaagagctgcttggt

SEQ ID NO: 7963 - DNA, 50 bp, Homo sapiens; identical to SEQ ID NO: 7644

SEQ ID NO: 7964 - DNA, 50 bp, Homo sapiens
agtcctgtatcatccatacttgtactaccttgtcctatgaagctctgaga

SEQ ID NO: 7965 - DNA, 50 bp, Homo sapiens
ttggccgcttccctacccacagggcctgacttttacagcttttctctttt

SEQ ID NO: 7966 - DNA, 50 bp, Homo sapiens
tatgacacagcagctcctttgtaagtaccaggtcatgtccatcccttggt

SEQ ID NO: 7967 - DNA, 50 bp, Homo sapiens; identical to SEQ ID NO: 1204

SEQ ID NO: 7968 - DNA, 50 bp, Homo sapiens
tgcatagatgacctttggattattggactctgactattgggaccctaaat

SEQ ID NO: 7969 - DNA, 50 bp, Homo sapiens
tggacgccctaagaaacagagaaaacagaaataacaaccaggaactgctt

SEQ ID NO: 7970 - DNA, 50 bp, Homo sapiens
caatagcttgtgggtctgtgaagactgcggtgtttgagtttctcacaccc

SEQ ID NO: 7971 - DNA, 50 bp, Homo sapiens
tgcactgtactctcttcataggattgtaaaggtgttctaatccaattgca

SEQ ID NO: 7972 - DNA, 50 bp, Homo sapiens
tgaagtcatttcattgggaaggaaagctgcaaagattattgggggactag

SEQ ID NO: 7973 - DNA, 50 bp, Homo sapiens
tttcatctggcccaccctccttagactctcctcccttcaagagttggagc

SEQ ID NO: 7974 - DNA, 50 bp, Homo sapiens
gtgtagaattcggatccagtcatctcacagaactttccactagggtgcca

SEQ ID NO: 7975 - DNA, 50 bp, Homo sapiens
cggaccccagtttcttgtaccaagggggaaacatgcggggaccccaatgg

SEQ ID NO: 7976 - DNA, 50 bp, Homo sapiens; identical to SEQ ID NO: 1511

SEQ ID NO: 7977 - DNA, 50 bp, Homo sapiens
aacacaacactaaaaccgaacacacacgtactaacacacccacgacccaa

SEQ ID NO: 7978 - DNA, 50 bp, Homo sapiens
ccttctggttctgcttttgaccagcatttttgtgcccctctgttactgtg

SEQ ID NO: 7979 - DNA, 50 bp, Homo sapiens
gatatacgaaacacaccactggacgatgcgaaaaacgagacgacataagc

SEQ ID NO: 7980 - DNA, 50 bp, Homo sapiens
tggacaggcatgaaaggttacaaatgggagaaaactcacacacgttatgt

SEQ ID NO: 7981 - DNA, 50 bp, Homo sapiens
gcaggagagcgagagaggagaagaagaggcaggagggagaaagagcgtac

SEQ ID NO: 7982 - DNA, 50 bp, Homo sapiens; identical to SEQ ID NO: 3889

SEQ ID NO: 7983 - DNA, 50 bp, Homo sapiens
agaggaaagaataggaccagtgccgaggtatagggaggagggcatactaa

SEQ ID NO: 7984 - DNA, 50 bp, Homo sapiens
tcggagtaagggcgattgtctcgttaggtaatacatcatcttcgtgcata

SEQ ID NO: 7985 - DNA, 50 bp, Homo sapiens
agacaagacgagcaacgacaaccacagcagctccatacactctgcctctc

SEQ ID NO: 7986 - DNA, 50 bp, Homo sapiens; identical to SEQ ID NO: 2595

SEQ ID NO: 7987 - DNA, 50 bp, Homo sapiens; identical to SEQ ID NO: 1567

SEQ ID NO: 7988 - DNA, 50 bp, Homo sapiens; identical to SEQ ID NO: 1572

SEQ ID NO: 7989 - DNA, 50 bp, Homo sapiens
cgtgccagatataactgtcttgtttcagtgagagacgccctatttctatg

SEQ ID NO: 7990 - DNA, 50 bp, Homo sapiens
tccctgaggcttgtgtatgttggatattgtggtgttttagatcactgagt

SEQ ID NO: 7991 - DNA, 50 bp, Homo sapiens
cagagaagaaacctactacagaggagaagaagcctgctgcataaactctt

SEQ ID NO: 7992 - DNA, 50 bp, Homo sapiens
tcagaacatagatatgtattcagcttgtcttcaaatacggccaagcagaa

SEQ ID NO: 7993 - DNA, 50 bp, Homo sapiens
ttggggtcaagtgaaagggtagggggatagtcctgatcaagtgtgataaa

SEQ ID NO: 7994 - DNA, 50 bp, Homo sapiens; identical to SEQ ID NO: 1626

SEQ ID NO: 7995 - DNA, 50 bp, Homo sapiens
ccttctcttcatgtgtgtaaatctgtaatataccattctctgtggcctgt

SEQ ID NO: 7996 - DNA, 50 bp, Homo sapiens
ggatggcacttccccaccggatggacagttattttgttgataagtaaccc

SEQ ID NO: 7997 - DNA, 50 bp, Homo sapiens
tgagtcagtgtctttactgagctggaagcctctgaaagttattaaaggca

SEQ ID NO: 7998 - DNA, 50 bp, Homo sapiens; identical to SEQ ID NO: 1636

SEQ ID NO: 7999 - DNA, 50 bp, Homo sapiens
gtggcttgctagtctgttacgttaacatgcttttctaaaattgcttcacg

SEQ ID NO: 8000 - DNA, 50 bp, Homo sapiens
ttgtactcactgggctgtgctctcccctgtttacccgatgtatggaaata

SEQ ID NO: 8001 - DNA, 50 bp, Homo sapiens; identical to SEQ ID NO: 2774

SEQ ID NO: 8002 - DNA, 50 bp, Homo sapiens
ttgttgttttccctgatttagcaagcaagtaattttctcccaagctgatt

SEQ ID NO: 8003 - DNA, 50 bp, Homo sapiens
ttagaaacaaaaagagctttccttctccaggaatactgaacatgggagct

SEQ ID NO: 8004 - DNA, 50 bp, Homo sapiens; identical to SEQ ID NO: 2180

SEQ ID NO: 8005 - DNA, 50 bp, Homo sapiens
gatgtctggtgcccaatcccaggaagtgagagccatttcttttgtactgg

SEQ ID NO: 8006 - DNA, 50 bp, Homo sapiens
agttggactaaatgctcttccttcagaggattatccggggcatctactca

SEQ ID NO: 8007 - DNA, 50 bp, Homo sapiens; identical to SEQ ID NO: 1736

SEQ ID NO: 8008 - DNA, 50 bp, Homo sapiens
aaacacatacacacaaaacagcaaacttcaggtaactattttggattgca

SEQ ID NO: 8009 - DNA, 50 bp, Homo sapiens
ctgaggatgagctggaaggagtgagaggggacaaaacccaccttgttgga

SEQ ID NO: 8010 - DNA, 50 bp, Homo sapiens; identical to SEQ ID NO: 7353

SEQ ID NO: 8011 - DNA, 50 bp, Homo sapiens; identical to SEQ ID NO: 1465

SEQ ID NO: 8012 - DNA, 50 bp, Homo sapiens; identical to SEQ ID NO: 1777

SEQ ID NO: 8013 - DNA, 50 bp, Homo sapiens; identical to SEQ ID NO: 4556

SEQ ID NO: 8014 - DNA, 50 bp, Homo sapiens
ggacagcccacagggaggtggtggacggactgtaattgatagattgatta

SEQ ID NO: 8015 - DNA, 50 bp, Homo sapiens
attgaagccgactctggccctggcccttacttgcttctctagctctctag

SEQ ID NO: 8016 - DNA, 50 bp, Homo sapiens
actagactttatgccatggtgctttcagtttaatgctgtgtctctgtcag

SEQ ID NO: 8017 - DNA, 50 bp, Homo sapiens
gagccatatgaaagagaccatgccgtggtcgtgggagtgtacaggccacc

SEQ ID NO: 8018 - DNA, 50 bp, Homo sapiens
ataacagactccagctcctggtccacccggcatgtcagtcagcactctgg

SEQ ID NO: 8019 - DNA, 50 bp, Homo sapiens
ctggcctctgtgtcctagaagggaccctcctgtggtctttgtcttgattt

SEQ ID NO: 8020 - DNA, 50 bp, Homo sapiens
cccaaagctcactttacaaaatatttcctcagtactttgcagaaaacacc

SEQ ID NO: 8021 - DNA, 50 bp, Homo sapiens
atgtctgctagaaagtgttgtagttgattgaccaaaccagttcataaggg

SEQ ID NO: 8022 - DNA, 50 bp, Homo sapiens
ctctgcatgttctgctcttgtgcccttctgagcccacaataaaggctgag

SEQ ID NO: 8023 - DNA, 50 bp, Homo sapiens
tgcatcgtaaaacctttcagaaggaaaggagaatgttttgtggacacgtt

SEQ ID NO: 8024 - DNA, 50 bp, Homo sapiens
agccctattcatgtctctacccactatgcacagattaaacttcacctaca

SEQ ID NO: 8025 - DNA, 50 bp, Homo sapiens
agtgacagtgaacttaagcaaattaccctcctacccaattctatggaata

SEQ ID NO: 8026 - DNA, 50 bp, Homo sapiens
acacatgccctgaatgaattgctaaatttcaaaggaaatggaccctgctt

SEQ ID NO: 8027 - DNA, 50 bp, Homo sapiens
gccactgaaccaatcactttgtatgctatgctcctactgtgatggaaaac

SEQ ID NO: 8028 - DNA, 50 bp, Homo sapiens; identical to SEQ ID NO: 3262

SEQ ID NO: 8029 - DNA, 50 bp, Homo sapiens; identical to SEQ ID NO: 4798

SEQ ID NO: 8030 - DNA, 50 bp, Homo sapiens
gctccatgttctgacttagggcaatttgattctgcacttggggtctgtct

SEQ ID NO: 8031 - DNA, 50 bp, Homo sapiens
gcagcagcttaatttttctgtattgcagtgtttataggcttcttgtgtgt

SEQ ID NO: 8032 - DNA, 50 bp, Homo sapiens; identical to SEQ ID NO: 106

SEQ ID NO: 8033 - DNA, 50 bp, Homo sapiens; identical to SEQ ID NO: 8024

SEQ ID NO: 8034 - DNA, 50 bp, Homo sapiens
acatggaagactaaactcatgcttattgctaaatgtggtctttgccaact

SEQ ID NO: 8035 - DNA, 50 bp, Homo sapiens
agacccctgtgatgcctgtgacctcaattaaagcaattcctttgacctgt

SEQ ID NO: 8036 - DNA, 50 bp, Homo sapiens; identical to SEQ ID NO: 2893

SEQ ID NO: 8037 - DNA, 50 bp, Homo sapiens
ctgtagactcagtgccagccacagcttcagagattgtgctcacatggtat

SEQ ID NO: 8038 - DNA, 50 bp, Homo sapiens
tgacaaaggattttacgtttataaaattatgacagaagccatgtgccccg

SEQ ID NO: 8039 - DNA, 50 bp, Homo sapiens
gtctgccctgctggctggaaacctggtagtgaaacaataatcccagatcc

SEQ ID NO: 8040 - DNA, 50 bp, Homo sapiens
ctcgtcatacaatgcctgatgggctcctgtcaccctccacgtctccacag

SEQ ID NO: 8041 - DNA, 50 bp, Homo sapiens
ctagggagccgcaccttatcatgtaccatcaataaagtaccctgtgctca

SEQ ID NO: 8042 - DNA, 50 bp, Homo sapiens
tccgtatccattacttcgacccacagtactttgaatttgagtttgaggct

SEQ ID NO: 8043 - DNA, 50 bp, Homo sapiens
ccagtcctccacacccaaactgtttctgattggcttttagctttttgttg

SEQ ID NO: 8044 - DNA, 50 bp, Homo sapiens
ctgttgtctctctgaggctgccagttgttgtgtgttaccgatgccagaag

SEQ ID NO: 8045 - DNA, 50 bp, Homo sapiens
aatatagtcaagcaagtttgttccaggtgacccattgagctgtgtatgca

SEQ ID NO: 8046 - DNA, 50 bp, Homo sapiens
tttgctattttcgtcatgcctttgagactgagtcttactccgtcccccag

SEQ ID NO: 8047 - DNA, 50 bp, Homo sapiens; identical to SEQ ID NO: 2117

SEQ ID NO: 8048 - DNA, 50 bp, Homo sapiens
caggaaggaggtaggcacctttctgagcttattctattccccacccacac

SEQ ID NO: 8049 - DNA, 50 bp, Homo sapiens
gggagccatccctctctaccaaggtggcaatgatggagggaacttgcatg

SEQ ID NO: 8050 - DNA, 50 bp, Homo sapiens
tggcccgcaatactgtaggaacaagcatgatcttgttactgtgatatttt

SEQ ID NO: 8051 - DNA, 50 bp, Homo sapiens; identical to SEQ ID NO: 2151

SEQ ID NO: 8052 - DNA, 50 bp, Homo sapiens; identical to SEQ ID NO: 4517

SEQ ID NO: 8053 - DNA, 50 bp, Homo sapiens
tggggactatagtgcaacctatttgggtaaagaaaccatttgctaaaatg

SEQ ID NO: 8054 - DNA, 50 bp, Homo sapiens; identical to SEQ ID NO: 2269

SEQ ID NO: 8055 - DNA, 50 bp, Homo sapiens; identical to SEQ ID NO: 2480

SEQ ID NO: 8056 - DNA, 50 bp, Homo sapiens
gaggaggttgcccagaagaaaaagatatcccagaagaaactgaagaaaca

SEQ ID NO: 8057 - DNA, 50 bp, Homo sapiens
aacctaccagcccttctcccccaataactgtgggtctatacagagtcaat

SEQ ID NO: 8058 - DNA, 50 bp, Homo sapiens
agagagttggaccactattgtgtgttgctaatcattgactgtagtcccaa

SEQ ID NO: 8059 - DNA, 50 bp, Homo sapiens
ccctgtactgctgctgcgacctgatgctgccagtctgttaaaataaagat

SEQ ID NO: 8060 - DNA, 50 bp, Homo sapiens; identical to SEQ ID NO: 2106

SEQ ID NO: 8061 - DNA, 50 bp, Homo sapiens; identical to SEQ ID NO: 106

SEQ ID NO: 8062 - DNA, 50 bp, Homo sapiens; identical to SEQ ID NO: 2926

SEQ ID NO: 8063 - DNA, 50 bp, Homo sapiens
tctctgctcaatctctgcttggctccaaggacctgggatctcctggtacg

SEQ ID NO: 8064 - DNA, 50 bp, Homo sapiens
tgtcttactcaagttcaaacctccagcctgtgaatcaactgtgtctcttt

SEQ ID NO: 8065 - DNA, 50 bp, Homo sapiens; identical to SEQ ID NO: 4159

SEQ ID NO: 8066 - DNA, 50 bp, Homo sapiens
tggtgagtggaatttgacattgtccaaacctttttcatttttgagtgatt

SEQ ID NO: 8067 - DNA, 50 bp, Homo sapiens
gagtgaggaagacccccaagcatagactcgggtactgtgatgatggctgc

SEQ ID NO: 8068 - DNA, 50 bp, Homo sapiens
tggcaaagcccctcacactgcaagggattgtagataacactgacttgttt

SEQ ID NO: 8069 - DNA, 50 bp, Homo sapiens
ggaaaggaaactttgaaccttatgtaccgagcaaatgccaggtctagcaa

SEQ ID NO: 8070 - DNA, 50 bp, Homo sapiens
agttaagattattcagaaggtcggggattggagctaagctgccacctggt

SEQ ID NO: 8071 - DNA, 50 bp, Homo sapiens
ttaccttgtggatgctagtgctgtagagttcactgttgtacacagtctgt

SEQ ID NO: 8072 - DNA, 50 bp, Homo sapiens
ggggtcttcacattatcataacctctcctctaaaggggaggcattaaaat

SEQ ID NO: 8073 - DNA, 50 bp, Homo sapiens
tttccttgtgcaattcagacttaagcatcgagtttttaccatcttccact

SEQ ID NO: 8074 - DNA, 50 bp, Homo sapiens; identical to SEQ ID NO: 3840

SEQ ID NO: 8075 - DNA, 50 bp, Homo sapiens
aaatgtagcttttggggagggaggggaaatgtaatactggaataatttgt

SEQ ID NO: 8076 - DNA, 50 bp, Homo sapiens
acccactgcaaaagtagtagtcaagtgtctaggtctttgatattgctctt

SEQ ID NO: 8077 - DNA, 50 bp, Homo sapiens
gcctgctgtgaactgctttccctcggaatgtttccgtaacaggacattaa

SEQ ID NO: 8078 - DNA, 50 bp, Homo sapiens; identical to SEQ ID NO: 2582

SEQ ID NO: 8079 - DNA, 50 bp, Homo sapiens; identical to SEQ ID NO: 2817

SEQ ID NO: 8080 - DNA, 50 bp, Homo sapiens; identical to SEQ ID NO: 3865

SEQ ID NO: 8081 - DNA, 50 bp, Homo sapiens
ttgggggaaatgttgtgggggtggggttgagttgggggtattttctaatt

SEQ ID NO: 8082 - DNA, 50 bp, Homo sapiens
agcatggtaaacctgggttttgttcatattttctccagacagaaatgcaa

SEQ ID NO: 8083 - DNA, 50 bp, Homo sapiens; identical to SEQ ID NO: 887

SEQ ID NO: 8084 - DNA, 50 bp, Homo sapiens
gcccttgatgctggagtcacatctgttgatagctggagaactttagtttc

SEQ ID NO: 8085 - DNA, 50 bp, Homo sapiens
gccgattccaagcgagggatttaatccttacatttttgcccatttggctc

SEQ ID NO: 8086 - DNA, 50 bp, Homo sapiens
ttccctggacagtttgatgtgcttatggttgagatttataatctgcttgt

SEQ ID NO: 8087 - DNA, 50 bp, Homo sapiens
ggcggtgactgccccagacttggttttgtaatgatttgtacaggaataaa

SEQ ID NO: 8088 - DNA, 50 bp, Homo sapiens
tgaccatttggaggggcggggcctcctagaagaaccttcttagacaatgg

SEQ ID NO: 8089 - DNA, 50 bp, Homo sapiens
cagtcctcacaccagccaaggtcacaggcaagagcaagaagagaaactga

SEQ ID NO: 8090 - DNA, 50 bp, Homo sapiens
cctcagtgatggaatatcatgaatgtgagtcattatgtagctgtcgtaca

SEQ ID NO: 8091 - DNA, 50 bp, Homo sapiens
acacacaacttcagctttgcatcacgagtcttgtattccaagaaaatcaa

SEQ ID NO: 8092 - DNA, 50 bp, Homo sapiens
ggaatttcgcaccagaggacccaccacgtcctcgcttcgacatcttgaac

SEQ ID NO: 8093 - DNA, 50 bp, Homo sapiens; identical to SEQ ID NO: 2067

SEQ ID NO: 8094 - DNA, 50 bp, Homo sapiens
cagagaaagaaaaggcaaaagactggtttgtttgcttaatttccttctgt

SEQ ID NO: 8095 - DNA, 50 bp, Homo sapiens
gaaagcagggaagcagtgtgaactctttattcactcccagcctgtcctgt

SEQ ID NO: 8096 - DNA, 50 bp, Homo sapiens; identical to SEQ ID NO: 7214

SEQ ID NO: 8097 - DNA, 50 bp, Homo sapiens; identical to SEQ ID NO: 75

SEQ ID NO: 8098 - DNA, 50 bp, Homo sapiens; identical to SEQ ID NO: 7278

SEQ ID NO: 8099 - DNA, 50 bp, Homo sapiens
tgcaactagcaactcatcttcggaagacacagccaggagaatgaagtaga

SEQ ID NO: 8100 - DNA, 50 bp, Homo sapiens
gactttcctctctgcgagcttctacttctaagtctgaatccagtcagaaa

SEQ ID NO: 8101 - DNA, 50 bp, Homo sapiens
gtttctctttggttttccagattttctttagaacggtgactgaccctcct

SEQ ID NO: 8102 - DNA, 50 bp, Homo sapiens
ctgagcaataactagcataaccccttggggcctctaaacgggtcttgagg

SEQ ID NO: 8103 - DNA, 50 bp, Homo sapiens
tgcccatttcacattgctcattactcatgcaaatttcttcttgctaacct

SEQ ID NO: 8104 - DNA, 50 bp, Homo sapiens
acccaccattggtaaaatattcaggggaacttggtttaaaagtttatgct

SEQ ID NO: 8105 - DNA, 50 bp, Homo sapiens
gtcaaataaggttgttctttccttgaaggacagcacccatgccacagcac

SEQ ID NO: 8106 - DNA, 50 bp, Homo sapiens
ctggaaaaacatcacatggttgagtcaaggatgaaaagtcaaaactacct

SEQ ID NO: 8107 - DNA, 50 bp, Homo sapiens
atccatccaataaacacagcaacaccctatgctactgaccaagcaaagct

SEQ ID NO: 8108 - DNA, 50 bp, Homo sapiens
tagttagagtccaagacatggttcctccccctttgtctgtacatcctggc

SEQ ID NO: 8109 - DNA, 50 bp, Homo sapiens
cagcctgcctgcttgccatttttcttccccttccatttttctaacctcag

SEQ ID NO: 8110 - DNA, 50 bp, Homo sapiens
acttcctccccctccccctagcattacttatatgatatgtttccataccc

SEQ ID NO: 8111 - DNA, 50 bp, Homo sapiens; identical to SEQ ID NO: 6215

SEQ ID NO: 8112 - DNA, 50 bp, Homo sapiens
tttgcatcccgagttttgtattccaagaaaatcaaagggggccaatttgt

SEQ ID NO: 8113 - DNA, 51 bp, Homo sapiens; identical to SEQ ID NO: 5699

SEQ ID NO: 8114 - DNA, 50 bp, Homo sapiens
aaaaacggtttatgggggtagggaaacaggccgaaaagaacgtggagaaa

SEQ ID NO: 8115 - DNA, 50 bp, Homo sapiens
ggggactcaggcccccgctgggggtcccacatagggtttttatccaaaaa

SEQ ID NO: 8116 - DNA, 50 bp, Homo sapiens; identical to SEQ ID NO: 4235

SEQ ID NO: 8117 - DNA, 50 bp, Homo sapiens; identical to SEQ ID NO: 6061

SEQ ID NO: 8118 - DNA, 50 bp, Homo sapiens; identical to SEQ ID NO: 6136

SEQ ID NO: 8119 - DNA, 50 bp, Homo sapiens
agccatagaaggtgttcaggtattgcactgccaactctttgtccgttttg

SEQ ID NO: 8120 - DNA, 50 bp, Homo sapiens
ccatgcccttgtcatcaatcttgaatcccatagctgcttgaatctgctgc

SEQ ID NO: 8121 - DNA, 50 bp, Homo sapiens
ttaagaatgtggcagaaatgtatgctgaggtagcccagtcaatccttatt

SEQ ID NO: 8122 - DNA, 50 bp, Homo sapiens
atcagtagcaaaacaaacccagcaacttctgtccagcatctgctgtaggg

SEQ ID NO: 8123 - DNA, 50 bp, Homo sapiens
cccatctaactagcacacgaaccttccacgaggacgcctggcgagagaag

SEQ ID NO: 8124 - DNA, 50 bp, Homo sapiens
gaacttggcagttgtagcagaggcagttgaggcttgttgaccatcaccat

SEQ ID NO: 8125 - DNA, 50 bp, Homo sapiens
cgctctctcctgcacagcaccaccaccaacagtctggatgattttaggca

SEQ ID NO: 8126 - DNA, 50 bp, Homo sapiens
ttttgggaagaaaaccctatgcatctgaaatacaattggcaatggaagct

SEQ ID NO: 8127 - DNA, 50 bp, Homo sapiens
ctctttgttgctactcatttctctccggcgtctgctgaggggtaggtgtc

SEQ ID NO: 8128 - DNA, 50 bp, Homo sapiens
caacttcctcttggttacccagaagaacagcagcaccgtgatccagagca

SEQ ID NO: 8129 - DNA, 50 bp, Homo sapiens
ctgtacatctgcatcccagcaaagagcagcagggacaggagggaggagag

SEQ ID NO: 8130 - DNA, 50 bp, Homo sapiens
cacagacagaaggtttcgttcctcattcgacagtggctcattcagctctg

SEQ ID NO: 8131 - DNA, 50 bp, Homo sapiens
tcaagattggcaattcactgtgcccattaaaccactcagtagctcagcct

SEQ ID NO: 8132 - DNA, 50 bp, Homo sapiens
agttgtcctgagagttttacacttgtgagaaaatactggcagctttgatt

SEQ ID NO: 8133 - DNA, 50 bp, Homo sapiens
cacataggaatccttctgacccatgcccaccatcacgccctggtgcctgg

SEQ ID NO: 8134 - DNA, 50 bp, Homo sapiens
aacaggaacctttatctctttgtgaggcgatttgcattctccacacaggc

SEQ ID NO: 8135 - DNA, 50 bp, Homo sapiens
gtacttgccgccggtggcctcattgtagtacacgttgatgcgttccagct

SEQ ID NO: 8136 - DNA, 50 bp, Homo sapiens
atagtggctagggattaggaggcgaaggcgacaggagcagacaccgggtc

SEQ ID NO: 8137 - DNA, 50 bp, Homo sapiens
cattttggcttttaggggtagttttcacgacacctgtgttctggcggcaa

SEQ ID NO: 8138 - DNA, 50 bp, Homo sapiens
ccctggttcaggaattaaggggacagacttgaataagaaacaaaacaaaa

SEQ ID NO: 8139 - DNA, 50 bp, Homo sapiens
acagtagagaatttgagtacacagggtatggagagtagggcacaaaatgt

SEQ ID NO: 8140 - DNA, 50 bp, Homo sapiens
gaacagcctcgtctttccccgaatgccaggcaggatgacgatgaacgtgg

SEQ ID NO: 8141 - DNA, 50 bp, Homo sapiens
gacctccagaatttcctcatcgctgtcggtgaccaagtccacagacacta

SEQ ID NO: 8142 - DNA, 50 bp, Homo sapiens
tcttgccatcctatggaactgcctcggtgagttttctccttcattacaga

SEQ ID NO: 8143 - DNA, 50 bp, Homo sapiens
tgttactccttcaagcccctgaatcactatagccacgactctccaactga

SEQ ID NO: 8144 - DNA, 290 bp, Homo sapiens
  misc_feature (1)..(290): N=A,T,C, or G
agtcaacctaccaaagaccatacctgacacctaggctctctcacccaatggaatagactctaatggtgatacataccaataangggaaatctagtggtggtaaactgtttatgcctcattctatgaaagctgaaagattgctgttagctgtatgatgtataatgctaatcgcgatangggtacattgtcttctacagactcctacatatgtatgattatcacagtatgatgccagatactaacattcatattgaacaaatggctggcgtgggtagatgtcaagagaacat

SEQ ID NO: 8145 - DNA, 386 bp, Homo sapiens
ggcaggtggagaacacaaacgagtgagagctgactgtagtcgaagatcatacaaggaaaggtaagaaggcctgcaagctgtgaattagacataatacattattaattataggatgtaacattatgtatatggggaatatatatctaaacttatttatcaatatttaatattatatatatggggtatgtgtatgtaaacgcatatatattatatatatgtattattaataacttttgtgttatgagactgaatatctataaatatatgttttattaataattactatatgctgtgtaagtatcacgttatattttgtgtgctgactaagtaagcaacgctatgtagatacaaagagttgtgtgatggagtccactggtgatacaacg

SEQ ID NO: 8146 - DNA, 354 bp, Homo sapiens
cgagtacaagctttttttttttattttatttcttgttctggctatgatgacaaactgggtagtatatgatatatataacgtagagaagagtaacatatagacacaaaaaatatatatgagtcatgtattaactagaaatgcacataagataaaatggcctattgaatcatgtttttattatagatatattacaaaatggcattgaaggaaacctacttatttttcaatatgagaacaacagaaggcttttatgtatcacgaaaataacaatatatctgattttataatttataatttacattacataagctgagaactacacaataaaaactcaccaatattgaatattatata

SEQ ID NO: 8147 - DNA, 226 bp, Homo sapiens
atctcgaaggcaactcgcatgcacactagcaacatatataaacaatcttatattagactgtaaatggaaactgtaaagtgattagcttgaatcttttgtgcgaaagatttgtaacagacaatcgggtgaaatcacctcgcgcatgttatggagagattgtgacgttcaggacaaaacgagtaacagactgatcttctgtttgatactacgaccaggactccaggac

SEQ ID NO: 8148 - DNA, 530 bp, Homo sapiens
  misc_feature (1)..(530): N=A,T,C, or G
gacactgagtctaggaatangcacatatggagctaaagacctatgctttaaatactctaaatatatagactacacaaaaacatatgggaaaaatgtactgatgctaagataatattgttgatatcatattgtagaaactataactttaaaccaatagttgtgagcataaatgttacagtgatattgtgtgtaatatatagtacatgtaaaaatgaaactaaatttatatataattgtatatatgacatcaacaatgtaattgatattcttgctgttatcacaacactcgaaattaatgaatgctacagacatggattaaaaagactangctctctaaagagataaagaatattacttaaagcacatattattatgtgtaatacactattagaagattagatctaaactatacaacacanaacgtacttcttttcatcatcctctgctacaaactattgccctcctcaaaatatagacgattgctaaaagagtctgagcgatgatgccatcaatgaacaaacgttttgagt

SEQ ID NO: 8149 - DNA, 514 bp, Homo sapiens
  misc_feature (1)..(514): N = A, T, C, or G
tgtcttggagtaaattttaagttcatggatgtaatgtggtctacaggaatactgtatttgtaaaaaaataagaacattctgcaactgtagaaatgaccccattatatattttctgaaaatgaaaacagttacatgaaaaaaatgaccaatgaacatgtcatcatttgatgaaaaaccagaagttattagatgagagcagcgagtgaatctttaaaacagacttgatcacgcacactcaataagtaatatctctccgaaaccggatgtcattctatatctgttagaaataatgtcatcaaaagaaagtaaattagaggatatttttgccaatagtttatacaaaatatatgaaccaaagagattggaatttgtaaaaatgtaaaatagtatgaacaatatttgcactctaccatatttgaacatctnnatgagttcacattcatactaggttatcaacattgcgttctttttgcattcattctttactgttattaaaagttcaaaaccaatataa

SEQ ID NO: 8150 - DNA, 170 bp, Homo sapiens
  misc_feature (1)..(170): N = A, T, C or G
ccactattatgggatttgttttagtccattatggattctggatattcaancatttacaatgtagcatatttgattttcttttttctttctttttttggcatcattaacatttcatttgaaatgcatattgttcttgaagtacctcggccgcgaccacgctaatcactagt

SEQ ID NO: 8151 - DNA, 162 bp, Homo sapiens
aggcgacagggaatggcaagtttctgaagtcggcatagcttagttgttgcatccagcagagagacagcacagggagcagcctacgcaggaagattacaacagaggaataacacagaatacaatctgggatggataatagtgaatggcatccactagatgatt

SEQ ID NO: 8152 - DNA, 498 bp, Homo sapiens
cagtctttttttttttttttttttttttttttttgggtttggaacctttaataaaaataaaaaaggaatgcaaaaagaacacaatgttgaaaacttaatatgaatgtgaacctcactagatgttcaaatctgggagagtgcaaattttggtcatactattttacatttttacaaactcaaatcactttggttcatatattttctataaactattggcaaaaaaatcctcaaatttacattcttttggctacattatttctaacagatatagatttacttccgggttcggagagaaagacttattgtgtgtgcgtgaacaagtctggtttaaagattcactcgctgctttcatctaataacttctggtttttcataaaatggtgacatcttcattggaaatttttttcatgttactggtttcattttcagaaaaattataagggggggattccaaaggtcagaaagatcctatttttttaaaaaaaaaaaattctggta

SEQ ID NO: 8153 - DNA, 194 bp, Homo sapiens
actattaagttctttcacaaaataatcatcttatatcaacacagtaccaatctaagtgtccgcaggagggttactttaacatctccctcctgtgtttactccaatgtttctccctttaggtatggtctgggtaaatcggtttatggatgcatctgtccacaccacgctcgcagcatgtcactctgcgcattaag

SEQ ID NO: 8154 - DNA, 178 bp, Homo sapiens
gtgcgctggctatggacacgtaaaggaattgccacatggtggacattgattgcaaattgttgaggggatggaaaggatgttggacgttctggtgaaaagctggaagatggccctaaattcttgaagtactggtgaagctgtcattgtcgatttgggtggtggatagcttctgtacgtg

SEQ ID NO: 8155 - DNA, 450 bp, Homo sapiens
caactattatactattctcttctgctttcattctgatgtggtctgtaatagcaaaatacatgacttatttgtgtggatggcaaaacaaaaggtgtgtgttggatggtctgcttatcagtggatgatacaacagtcaagcaaaacctcgcggccctaacccaaaatcgatgaatctttggaacttgaaagacaatctggcctgtatgaatgggcaaacagcgaccatcattcgaaatgaaactggtaggcagtcacatttgacattcatgatcttcactggctactcgtccagactcaaaacgctggtgactgttaacagtgtcaggttttaaccaagcggaattccattaaatatttgccccaatgctctggaaactgggagagaatctttgcactgtgatagctgctacactgtgcgcctgaacacagcgccattggtggtaccccccg

SEQ ID NO: 8156 - DNA, 178 bp, Homo sapiens
tatcatatacataaaacagatggctggggaggaaggaagacaaacaagaatgactcagctggatggacatacacttaatgcatgatcaatcatcaatctgtctgttatacattagttggtgagtgggatgtccatacattaactattgaatgaaaggtaagttatttaatatatttat

SEQ ID NO: 8157 - DNA, 226 bp, Homo sapiens
ttttttttttttttttttggttttgaacctttaataaaagtaaaaaatgaatgcaaaaagaacacaatgttgaaaacttaatatgaatgtgaacctcactagatgttcaaatctgggagagtgcaaattttgttcatactattttacattttttacaaactcaaatcactttggttcatatattttctattaactattggcaaaaaaatcctcaaactctcattcc

SEQ ID NO: 8158 - DNA, 530 bp, Homo sapiens
tactgactatggaaacatgaatatatgtaagggccattcatgatatatgaatgagaagagtaagctttcatatggaaaaacacaatcattcaaaaaatgaatgacatgctgatgtatagcaacacgcatcataaaatgaagagtatatcaataacatatctatgcttagataagtactaccttctgtgtattatagaacaataagtgtgcattggttgtactttgcaactaacgcatgggtatcatgggtatgcacccatcatgatggagtctggattaccatcttgcttttggataaaacagatctatttggggcatctacataggattaatagagagagaaagaggatatatgattcataaatcatatatgctctgatcaaatgcaagcatcattaaaaaacatatgctatctataactactcatcagattgctgtgatctatacactctctccacatattaatactgtgaaacttcaactatagcacattactctggatatgcaaagttagcacggtaggacatgaa

SEQ ID NO: 8159 - DNA, 578 bp, Homo sapiens
agcatttaatccaaacaggggttcttagcctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaaatagaaaaagcacttgaagaatattcccaatattcccggtcagcagtatcaaggctgacttgtgttcatgtggagtcattataaattctataaatcaattattccccttcggtcttaaaaatatatttactcataaacatttgtgttttgttgaaaagatggagtttacaaagataccattcttgagtcatggatttctctggtcacagaatggtgtggcatttggaaacgggaataaacaaaattgctgcatcaatgcactgagtgaaggaagagagacagaggatgaagggttttaga

SEQ ID NO: 8160 - DNA, 530 bp, Homo sapiens
ggtgaggtagtatgtgagtgaaataaatggatggaattagtgatatgaataattgaagtttgagaagtagaatggatgggcgtgttgtgattattagtaaaataagatagaagaatgttgtaagaattatatggatggatatgatatgtaggttattattgtaatttatacttttatgaattgtgaataaggaaatatattctatatagattaggagtgaaagaatcaggtttataaagtgaaataattaaatagaatgcagaaatgaagagaaagggatattgtgtaacatattattggaagaataattaaaatatttaatatgtgttataaaagtgaagataaaagtgtatttttatgaacagaattgttatgaaatattatttttacattaaattaaaagtgtattgagtgaatatgttaaggaatatttattggaaatattagagttaggtacaattgaagaaatgtgtgaatgaagaagaggaagtgattactgggtgaaattatagtgaattggaaataattga

SEQ ID NO: 8161 - DNA, 693 bp, Homo sapiens
gcggtggttgtgatcggctatgtgggtagcttggtggtgtggtggcggcagtgaggggctaggatgggtggtaggatatctaggactgagacggagacttgacctccacgatgcaacatccaatgagtatgctatgtgagaaaaatgagagattaacgagctaaatgcagtgtgtatgatgtgtgagaacatcacagatggatgatcgcacaagaggcatttgcatgatatgatcgcttcatagatggaataatcgaactggtgaatatgtatgagctgtgatgaatgttgctgcagaatccatctgttgaaccatgtatatgcaatgtgtgaggaggctagatgaatggatcatatcatgatgatgttaacaatgttgggtgagattgctatggtgacaaatcatgtggatgtatacaggaatatttctggttgctgcggttgacaaccatgggggatcagacaagagaagtagtagagagtgatgttgacatcgatgggggatacgcttataaatgatgaagtggatgacgtgtgcatgtggagcgtatacgatagttactaacgagtttggagcatagtgtgagtattatatattgtcaagttaataacgtggtggatgcattgttatagttgtttattgtgtgaaattgatatctggttataattatggtcataatttgtatcctgtaa

SEQ ID NO: 8162 - DNA, 194 bp, Homo sapiens
atgatagttgtgaaatgattgattggagggtaagttattggttgtttttagatttaggttagaaagaggaggtatgtggataggagtaaataatgtgattggtttattgggtgaaatattatgttttgttgtttggatatatggaggatggtgattttagtttggataatagaggttatataaatgcaatggaa

SEQ ID NO: 8163 - DNA, 466 bp, Homo sapiens
cagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgaagtttgttgaaaagatggaggttacaaagataccattcttgaagc

SEQ ID NO: 8164 - DNA, 672 bp, Homo sapiens
cccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaagataagctgaaagactgccttgaaaatcagcaaaagcttttagtgctgtcca

SEQ ID NO: 8165 - DNA, 514 bp, Homo sapiens
  misc_feature (1)..(514): N = A, T, C, or G
ggcttgggctgctggggcaggggcaactggaggcaagcggaaaacgacgattagttctttatgtatgataataaattaatattaatacatatanatatatagatattatgtaaatgttactatgataatggttatcgtttatacgttatcgtaatatcataagatttttatacaaaatcaaaatacgaagactactaacatgaggatggagaaggaaaaaagtttctgaatcttgaccgtggctgaggcggagacgattcttggacttggagctgtatctgtatgtaaatgaacatagaggaatacgactacagaacctaataccaataccaggacaatggctctgcatttaaatgatagtgactgtgactgaatacagtttaagttaattgttgtaggtgattgtgattatattaatgcgatagcgtatattgagatgaagatctaagtgattgtgaacacttgaccttgatgtccctggacacagtgcattagcgtcatttctaggtcacgc

SEQ ID NO: 8166 - DNA, 402 bp, Homo sapiens
  misc_feature (1)..(402): N= A, C, G, or T
ggtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgngagctttgttggtggtattgtattaacgctgggagttttatctattctttacattggatgcaaaaagtattactcagaagaagcattcgtatcgaaccataaatga

SEQ ID NO: 8167 - DNA, 322 bp, Homo sapiens
  misc_feature (1)..(322): N= A, T, C, or G
ttctcccttaaggactttggcaagaataacaagttcattggaatttgactttctgacatagagcagacagccttgccctgtcatgccaggcctttcatgtgaagttaccatttattagctgcttctgtctctccnagggaagatttcccttttataagcctgggccagggggatgatagtaagattccccatgtgataccagagttggaataagctgtagtgagattanggccaggactgtcccattttgattcttgaatggtttctgttacaacttgtcatgggggaaaaagtaacacttattttttttttcctcccttaa

SEQ ID NO: 8168 - DNA, 290 bp, Homo sapiens
tactatgatatgtgaatggaaaagtaggcagctgatgactcaaattaagaattttaattacattgactccaagtctgatattctgatgagtgtcatatagcacttaatgtctgcttcatataatactaccacttattagatatatatagactcaagagcattaacaaaagtagagaaagagtgagtcattatatacctatgagtaaaatatgaaaatgactatatgtgtctgtctgtgtcttgttatcggtgatgcaaatagttaattcttgatggaagctgtcgacgtg

SEQ ID NO: 8169 - DNA, 242 bp, Homo sapiens
  misc_feature (1)..(242): N = A, T, C, or G
cggtggtncatcgcttgntggtgtggttcttatnattaacnccattgtgtatacaggtttccagtcccttggggtacagtagtggttggccagatggttatgtaagtatttggagtcaggtgtataatggattttcgggtgatatggatgtaaagaaaagctttccttgttcacccggacttgaaatcgtggagttttaatagcagatcttcagcaggtgagagaatcacagctgcattcca

SEQ ID NO: 8170 - DNA, 178 bp, Homo sapiens
ctgtcgagaatggaggattcttacgtggacatgagttgcattgttctttgatgctgtaggcttattaaaagtatgtagtgactagtttccaggcacttggaatctgtgttcctatggttggcggcatagcagctagcatttttgatcaccatacagcagggcttcgggtagtcgcgat

SEQ ID NO: 8171 - DNA, 242 bp, Homo sapiens
  misc_feature (1)..(242): N = A, T, C, or G
ccagnaggttatccctgtacctgccctggtgattggccagcgaatcaggtctaaccagcacaactcccacctggaccagccgaaccagctctgagcatgagttgggtcagatctgaaacatcccctgcataaccccagcaagctacctcccctgctaattatggatgctcatctcctgcaagcatcaaccgcattggcagaagcagcaaacccacttcctccttgcttagcatggaccatgg

SEQ ID NO: 8172 - DNA, 722 bp, Homo sapiens
  misc_feature (1)..(722): n = A, T, C or G
gggaccgggaggtgacttagtgctgatactggcaattggnaaagatgagggacgnctgcttgcactccagcatgcggccatttttaattacattgtttcccaagtatgcatattctgnacatgtctatagcacttagtgtctgcttcatataaactaccagttattatatatttatgatgcaagtagttttccaaatgtggtgaaagtctgagtctttttatccccatgggtaaaatctgaatctggctctctgtgtctctctgtgcttgtttattgctggtcagagagtcaattcttgataaaagctgttgacttggctctcacagtttatgcagacattggagagacgatctggttatttcaaacatcacaggatctgagtaagaagacctggttatgaaacaaggctctcataattactagctatgactgttgacaagttaccttttcttgtttacaagttatttggcctctttgaattacttgtaaaatagagatagggattctttcttgatcatggaacatcaaatgaagttatttgatgaaatactttgttatctggaaattataaatatcacttcatgtttattattatttggaatttgggcttctcatggtggcattttctatggtcatttttttcttttcttgcataatggctataaagttagttagacatgcaaacaaatgccctaagtgggaaattttgaataggttaggg

SEQ ID NO: 8173 - DNA, 242 bp, Homo sapiens
ttgtttgcagagtcctcaaatgtatcacagaaaacagttgctgtggaaacttatagtggaccctactgacgcacaagcattaagaagtccacttgctgcatactgtaaggagaacttgctgcatttgggaaatgctgcttaaggcaacacacattacctttgtgacagggctctgtccactggggtgggctgatgcaatctatacagaatgcacatgctgcctttttttcttctttttttgc

SEQ ID NO: 8174 - DNA, 194 bp, Homo sapiens
  misc_feature (1)..(194): n = A, T, C or G
agcacgtaacccatccgatcccccaagattaaggaaaaagagtgggagagcaaatggaagaagcccctgctaacgggatgctaatgagaaatggggagcaggaggctgacaatgaggtagacgaagaagaggaagaaggtggggaggaagaggaggaggaagaagaaggngaaggtgaggggggggggggcggg

SEQ ID NO: 8175 - DNA, 354 bp, Homo sapiens
tttttttttttttttttttttttttgggcttcccaattattttaatgaagggattgggaggaggacatacaaaacggccagatacacagggtagcaggggcttgataatgagataattttcccccacgtgttgggaaaaaaaatactatgtatttttttatgaacactattaaaaaaaaataaacccactcacaacattttggagggactaaaggccaagagaaaccaatggagaatcattatttgggggatgggggggggagtttctggggggcagggggggatgtggacaggcaggggggggtggaggaaccttgcctctggcgggaatgggaaggagggacaaggaacaaa

SEQ ID NO: 8176 - DNA, 603 bp, Homo sapiens
ccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatattttgctttaaaatatattttggttattttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttggtccccgccg

SEQ ID NO: 8177 - DNA, 354 bp, Homo sapiens
ttattttatttatttggtattatgtttttttattttttttttttttgttatttttttttttttttgttttttttttttttttttttttttgttttttttttttttttttttgtttttgggggggggaataggagagggggggggaggggggggtgatgaagggggggggaaaagaggatttataatataaaaaaagggggaattaaagggggggagagaagttaatgaaaaggaggaaaaaaaaggatatattaataaaaaaaaattggaaaaaagggggagttttttattaagaggggggtatattttggggggaaaaaaatatggggggggggaaaaaaataatagtttggg

SEQ ID NO: 8178 - DNA, 352 bp, Homo sapiens
acggattgaattgactgatgcatgctcacatatgtctaaaaacaatctgtctgcaataacatgtcatgaatgtgtgactgactggtctgtccttgtgcgagctactacctgctgcctgctatcaatctctctaacaacgggtggacacacacccaccgactgctggttgtcttacacagagaggaaggatccttgcaactatctgggagattaatatgtaaccagcaacctgtgtttgcagccagctgtgggaggtcaaacaaacaaaagcatgcaagcatgtgcggactgaaccgagtgatgcgtgcgagagtacctgcctgggcggacggtcgcactctcttactattga

SEQ ID NO: 8179 - DNA, 464 bp, Homo sapiens
gctttttttttttttttttttttttttttttttttttttttttaaaaaactaaggaaattaattgggttcagggaaaaaaccggaaaaaatggtggaaaaaagtggtaaaaaaaggttaacttaaaaaatacaaaaaataccttggggtaaaattttggaaggggggggtatttaaaaaaaacggaaaaaaaaccaaaacctaaaatattgggaaaacaaaatattaacttttttttttttttaataaaggggggggattgtttttggaataaattaaccaaaaaaataaaggtacccctggtttttttaagggaaaattttttattttaatcaaaccctaaaaaaaccttggtaaggttttatcccattttaaggggggaaaaaaagggctaaaagggggaagggaaaatccttggtgggcaaaacggattatgggggcaaggtaattgaaatggaccccaaa

SEQ ID NO: 8180 - DNA, 448 bp, Homo sapiens
tacagttaccattgtacaatttatgaacacatggattaccttatgacaaagcattatatacaccactgtactagatgatgaagtgctaaccactcacatcactagcatgccttctatttatccaaatatttaaaggtgatatttattgtcgaatgggtggggtggtaccaatggtctctagtatggttagtgtgaaaactataaatatggatctttcagtgagctattagtgagcacctaggggctataagatggtttcacttattaatcacaaaatattcattattatggtgaatgttagatatactctctatgtaaattggttagtaaaacgagttagaagatatgatgaatacaaaaaaaataaaaacagacatgcatgggcggtggaggccatgatcttaaggaaaaaaatgttgtgtgagtcgtgtataacattaaatgaatc

SEQ ID NO: 8181 - DNA, 576 bp, Homo sapiens
caagtaaggggttgtacggtgctgcgaggtcgaatagcataccaatattggttgatctgtctgcaacattagaaatatggagatatatactatttatacatatttaacattaaatatatggggaatatatctttagactcatgaaaaagaataatgtattattatatgcatcatttgtgatatgatatatgactgtgacatgaatatatgaattatttgtaatctgtataaccagtgactgctctgcgaatatcactggtttatcgactgggccagctaggctatgagactacgcaggatcatatggggggcgcgctatgcaaccagccgaaacaagaaccactggagaagtgaggtgatactactcgatgactcgacgaacagctatatgtgaggcgatagtatccagtgcactgacggcttgacaatatgcacgcgaatgtgtccagtgctccaagggcatgacataacataaccagaaagtgtcaggcgggcgcgtagaaaacatgccgacaaatgagactgcacgcgtgcggcttcaaaaattgctgacaactgtgaccgctacctgccggt

SEQ ID NO: 8182 - DNA, 160 bp, Homo sapiens
gacaggggggggggggggggcggggggggggggggggggggggggggggggacgggcagaggggacctattggatgcaaaaaagaatatctatataaaaaaaatatagttgtttttttgtggtttagaaccaccagtaacaatgaaaaagtattcaataa

SEQ ID NO: 8183 - DNA, 208 bp, Homo sapiens
cagttgtcaacaatatttggtaagcaaccagacatgtaaatcttctgtagatgctttgtttttcattatggtgcacctgtacacatttcaagttctgttctgacatgtccattattatcactgtgctctttattgtcaagcatatttttttttaccggtctgtaaactgggatagttatcactttctctttttttatttgtttatttg

SEQ ID NO: 8184 - DNA, 160 bp, Homo sapiens
gaagtcttgtgttttactaatgggaaaaaaaaatacagaaaaaagttttgttactcatggctgccccaccgccagcctgggccctaaaaacagcccagcgcctcacttctggcttgggagaaatatttctttgctccttttgggaattcatggcttgatg

SEQ ID NO: 8185 - DNA, 160 bp, Homo sapiens
gaggtcctgcaaaccatctcaagaccaaaataagcgacccggcctatgtccccctgttattgggattgacccacacggcctctacattggcatgcctagttttgcttgcatctggaaagaaaaagaattgaatcgcacgtttctgggtaaaaaagctggg

SEQ ID NO: 8186 - DNA, 528 bp, Homo sapiens
tttttttttttttttttttttttttttttttttttttttaaaattaaaaaggaattattttttttattgccgggttttattaaagggggattttaaattaattcattggagggggtaaaggaaatggagtgggtgggtgggaaaaggcaggggggccaaaaattattacccattaaaattaaaagtggtttgggtgattggtggggttctggtgggttgggttgggtttttgtttttttgggggtgggttttctggtctttgttcttgaccacttttttaaccattggggttgggggataagaaaaaatttttaggcaaggttgggtattaaaaccacaaaaattttggggggaggaaaattaaatttattgttttaaaggagctttcggggagggggggggtttggtttttgttaccgggaggtgggggggtaggggggttaacacgggtctttttattggaaatttaattctcttaaactttcaaaatggttggcgggggaaaaaaaaaatggccgggagggccag

SEQ ID NO: 8187 - DNA, 384 bp, Homo sapiens
ttttttttttttttttttttttttttttttttttttttttttttttttttttttttttttttttttttttttttttttttttttttttttgggggggcaaaaaatttttttttttttttttggggttggaaaaattttttaagggaatttttggggggggaattttggggataagttttaaaaaaaaaaaaaaaagggggggtaatttttgggaatatttaaggaattaaacaaggtttttatattaattttaggggggggtttaaaaatttatttgggttttaaaaaagggtaccattaaaaaaaattgggattggcttttttagggggacttaaagaatttaagggggtttggggggggggaagggggttatataggggagg

SEQ ID NO: 8188 - DNA, 222 bp, Homo sapiens
cttttttttttttttttttttttttttttttttttttttttttttttttttttttttatggggaaatttacctttttttatttttttttaatattgaaaattttaaaaaaggaattatttttcatttggggtcccggccgggggggggggtaggatcacttgagtaatcaggggggcggtggatggggcgctgaggggagaacacaaacacagggcaggggg

SEQ ID NO: 8189 - DNA, 352 bp, Homo sapiens
tcttggtctaatatagggtatgtgtaatgaactgctagactgtatgcggtacatgaactatactagtgatggggtgctggctgcatattgtgtattactaggtctagttctatgtattaatatgctgcattgtggatatggggcaatatattttttggacgcatctctcttattagtatgatttatagtcctctttcgtgtaatgcaataatgaatatctattattagatggtattatttcttatgacctatatcctgtgactgtctctcttactcctttgtccgcggactgattaggcatggctatgtgtttacgtggctttatttctggggccatcctggcagtgcccct

SEQ ID NO: 8190 - DNA, 160 bp, Homo sapiens
agcttttttttttttttatttttttttttaatgtttgggtgtaaatttattaaaagatttgatttataatatttgtaatggtgactgtcaccttttttcctgccttgctactgatgggattattctgcttaatatattttttattagatgtgcaagttaa

SEQ ID NO: 8191 - DNA, 160 bp, Homo sapiens
tactgacatgcatgtactaactagggtctatggcatgacttgcataggctattacatgctgagttggtagcattagactgcatggtatcataataattgaacacaatgctgatgaagaatattatctcgtggtagttagtatatttataggcaagtggga

SEQ ID NO: 8192 - DNA, 480 bp, Homo sapiens
tacaagctttttttttttttttttttttttttttacaagctttttttttttttttttttttttttttttttttttttttttttaaaatatttttatttttattattttggtattaattaaaaatatgaaaaaaaaagtaaaaggggttcctttttggggggaggccaccttgatggcttaaaacaagcttaataaatcgaaaaaaaaaatgggatgccaaaagatggggggggaaaaagggcttgggggttaaaaggcgaaaaagttgggttagggggttgggggggggtaacagagggaaaaaaaaattcagtttaggggaccctaaggggacgggggggggggggggggtgagggacacttggaagggtttttggagggggattggggggggagggtttttgttattgggggagatccgggagggaggggcggggcagggtgggggtccagtggggtaaattttcttaagggcataaa

SEQ ID NO: 8193 - DNA, 240 bp, Homo sapiens
tagagcttttttttttttttttttttttttttttttttaataggttaaaaaaaaatttttattttttttaaggggtgttaaaaattggaataaagaatatgtataatatttgttagtggggggggtttggtgtaatgattgaatatataggaggatgaaagatatttggttgtaaatagataaaattgggagggaaggtggaggggaaagggggaattttaaaaagatatattaaaaaat

SEQ ID NO: 8194 - DNA, 224 bp, Homo sapiens
tattacatggcacgaggacccactgagaacacaacgcctgttgcggaacaagaacacggaatggggctaacaacagactaagtactttattgttaggcggataatatataactcatttggacaggcctgggccatatctctgactatgccctatattggatgcctggcaggggcccaagcccaagaggattctttaccctcggaacagctccccaggcactcag

SEQ ID NO: 8195 - DNA, 192 bp, Homo sapiens
ctaagattgataatttgtgtatgtgatataaacgttttattaccagatgtgtacatttaatgagctatcatttacattataaaggttgtgtgattctttgtattttttaaacacaatttttatattcaaatctgttggagcaatgaaaagatggagagcataaacaggtttttctatgctgatagaccatgg

SEQ ID NO: 8196 - DNA, 288 bp, Homo sapiens
tgatgaaagccaaattgacgcaggatatgaacctgttttgtattgtgataaggttaatattgtgtgcaattttggtgaaatgagagaaaagattgatcgtggttttggttgaaagatggatgatggtgcttgattgttggatgatggggatgatgacattgatgatatggctggtggaaagctgatgtgtggtgatagattcttaaactatggagatgctggtattgttgatgtgggtgatgtgaaacagatgagtgttgagagtgtcataaaatatagaggattaga

SEQ ID NO: 8197 - DNA, 304 bp, Homo sapiens
tttgatttttttgaaatatgttgatatgataatttatgatataatttggaggatagttggttatttttaattttataattacaaaaatattgtaaaaatttgtgtttagtatacatttttaatagttgtatgaaaggtgtatatgaatattataatgaaacatgttagtaagtgtaattaagaatgatatgaatatattttgtgttaatgatataaagaaatatgggattgatatttaaatgaaaatgtttgtattaaggataataatgataaatgttttaaattaatttactttaaaaaatta

SEQ ID NO: 8198 - DNA, 240 bp, Homo sapiens
tcgtgctaatggtggttctgaatgcaatatttgaatattaaatttaaatctatatattattatggaacataatttatatggggaatatattataagactcataactgaaataagtatgtataataaaaagaatatgtgtaatgataatgaatatctattaatatatagtatcagttataagttttatattatgtgagtgtcttaattaattattggttgtctgagtgatttaggcgacgt

SEQ ID NO: 8199 - DNA, 224 bp, Homo sapiens
agttgtatttaaaaaagcataagtatagattgtgttgggtagaaggagaggagaatgagttgatttgttgaagaggagggtgtttgtggatgaagaggagtaagagttgaaagtagaaagttgaatagatagggaagtgttgtgagtaaggaaaagtaaggaaaaggattcattataagagaaaatgttactgagtgaattaataatatgtaagtttggtttca

SEQ ID NO: 8200 - DNA, 704 bp, Homo sapiens
caagctttttttttttttttttttttttttttttggttttgaacctttaataaaagtaaaaaatgaatgcaaaaagaacacaatgttgaaaacttagtatgaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcactcgctgctttcatctaataacttctggtttttcataaaatgctgacatcttcattggaaatttttttcatgtaactgttttcattttcagaaaatatataagggggtcattcccaagttcagaatgatcctatttttttaaaaaacaaaattcctgtaaaacaaattaactccaggaacttaaaatttactccaagacatttccctcaaaacaaagcaaaaaacccagccaagatcgttacatcacaaaaccaaacacaaagaacagcgctcacaggcaagttcctctaagctttcattctgctgactggtggcttccattttaaaggagtctttttatccagccactttcacagaattttataac

SEQ ID NO: 8201 - DNA, 576 bp, Homo sapiens
atgagtgaagataaaatgaccagcagaggaatgcatgtctggtttcagagttgcaggttattatcctgaaccatacatgaacatcataagcgtgagtgtgatgaactgtatcggatagctacaaagcgcacattagaatgcgagtttgatgagttgaaaggaaaaatagattgccggtctgggtagtagttggaagatggttctaaattcttgaattctggtgatgatgactatgttgatatggttatttgggagatattgtgtgttaagagtttatcaaattattcttctttaggtcgatttgcgggtcatgatattaaatatatagtagtagatggtgtaatcataagtagcggaatacagtgatggtggaactggatacgttcgcaactctgctcataaagctcagatagctgaatgaatagtatcacttataggtgcccactaagtcttaatcattggtgagataacaggcgtagaattgtttgtttcatttgggattctatgtatagttataaatgaatggataatgatcacaatgtgtcgtataagcattatagcgagaagagagatgtc

SEQ ID NO: 8202 - DNA, 368 bp, Homo sapiens
ctcatgcaagtgataggtggaactgtcgcctgcagctaaaacagggaagcggaataagatgctgatgctgtgtcgaggtcgatgagcatcctggtagtggtggctgtgcctgcaatatttgaattttaaatctaaatctttttatttatatttaacattattgatatggggaatatatttttatacttatcattaatatatatatttataatttctgcttttgggtaatgaatatgtatatctatttatatttgttttatttattatttctatttactgtgactgtctcacttttttctttggtttctgtctgattagggttgggtatgtgatggcttagttttatggtcagggccgaattggcaggc

SEQ ID NO: 8203 - DNA, 672 bp, Homo sapiens
tttttttttttttttttttttttttttggttttgaacctttaataaaagtaaaaaatgaatggaaaaagaacacaatggtgaaaacttaatatgaatgcgaaccttacttgatggtcaaatctggtagagtgcaaattttggtcatactattttacatttttacaaactcaaatcactttgggtcatatattttctataaactattggcaaaaaaatcctcaaatttacattcttttgggtacattatttctaacagatatagatttacttccgggttcggagagaaagacttattgggtgtgcgtgatcaagtctggtttaaagattcactcgctggtttcatctaataacttctggtttttcataaaatggtgacatcttcattggaaatttttttcatggaactggtttcattttcagaaaatatataaggggggcattccaaagatcagaatgatcctatttttttaaaaaacaaaattcctgtaaaacaaattaactccaggaacttaaaatttactccaagacattttcctcaaaacaaagcaaaaaaacccaacaaagatcgctatatcacaaaaccaaacacaaagaccagcgctcacagggaagttcctcttaactttcattctgctgactggggggcttcatttaaaaagggtgttttaatg

SEQ ID NO: 8204 - DNA, 288 bp, Homo sapiens
  misc_feature (1)..(288): n = A, T, C, or G
catgagtccgcncagtgcggtaaaaattgntggaaaatctgacctgtggagtgccttacatatgtacttgaatagaagtggtcaataagattgattgcatactgcattggaaaaagacataaagaatgcttgacctatctatttatcctctctcatgatgtcttcgtntagaaaagttaaatatgctgttataagctcatagtttgcaattgcggatagtctcatgagagcttgatggatgaaggctagtaatctgtggtataagccatctggggaacgaggacagga

SEQ ID NO: 8205 - DNA, 160 bp, Homo sapiens
actgctgaacctttttatgttggttacttgtctatatatgctatcttttggtagtctttgctagcttttgatattgtgactgacaaaggtctgtggagtgtctatgagctccagcgtgacaacactgcctgctggcagcttggccagtgctcactcaaaa

SEQ ID NO: 8206 - DNA, 255 bp, Homo sapiens
  misc_feature (1)..(255): n = A, C, T or G
cagcttttttttttttttttttttttttttttttttttattttttaaaacaagcaaatttttattaaaggaaaaattttgcgagttttaaggtttgcgaggtgtaaattttgtgagggtgaaaaggtttactttttcacncagtctgtttctggcatgtcttttaatggatgtcagaagtccacctggtatcaatgtatatgccagtggtgcacactcttgtagttattttcccgcatgtctgtgcgccagtttt

SEQ ID NO: 8207 - DNA, 192 bp, Homo sapiens
  misc_feature (1)..(192): n = A, C, T, or G
tgttcgtgcggacaagnttgtggcgtacagcaaaaagcacccaccaaggcaagacagctgacttcatctgctcatntgtattatcctgcaaccatcctagtgcaaataaagcgccggactatgacctgctggtattgggattgagcacacgtgtctcacattgatatgtcaagtgttgactgaggctgagag

SEQ ID NO: 8208 - DNA, 224 bp, Homo sapiens
ttcccctttttttttttttttttttttttttttagggttttattttaaatgggaagggaaaaattaaaagttaagggaacattaaagtggaaaaaaaaagggaaacacttaaccccaacttttttgaaaaagaaaaaatgatgggggggggagaaaaggtaaggggggaaaaagggtatggggggattggggggggggggacgtgggaggaaaggggagggagg

SEQ ID NO: 8209 - DNA, 752 bp, Homo sapiens
ttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggttgtgtctagatgagttagggacagtcataaaagctggggatatgtcgcatttgcaatcagtagtagcatatttccagaatatgagccataaggtgcagtcctgaatacaacagtgttatccatagaaaggagctttctgacaaatatacatagccttactaatgagtacccctgcgccctccctcccaccgcacct

SEQ ID NO: 8210 - DNA, 368 bp, Homo sapiens
ttttttttttttttttttttttttttggttatttctatttttttttgtctttttgtataggctaatttgtcggatttggggatgagatattgaagggttgaaaggattatatactgtattggtggttggttggttggttgttgggctgggggaaggggggggaggtgggaaattaattaataaaatagtaataaggtcttagataaatattatagttaaagggaggaggggggggggtagggggataaaggggcaattgtgaaggggggatgggtggatgtttttgtggagctgtgggagtgaggatgttaaaatgatttatttttataggtaggagggtgggggggtggtgggtgttacgtggcggg

SEQ ID NO: 8211 - DNA, 690 bp, Homo sapiens
atgtggtgtgtggtggacacaaagttcatttttattttctttttcctttattttttcttatggtgaatgatggaagattaccgattaattacacatggcacatggataatggatgttggctgtcatattcaattgcaatttgttatagtgctgtgtgattaagtattgtttattgactattatttattctatatggtatataagaaggaagcaggaatgttagctgatgacacgtgaatatttattatacatgctgtgtgctgcgtccatgttgattgcttatgacgtatggcgtatggaacatttttaagtcattcttgatggtagctgatacctgatctgtgtgttgagttatcctgtatgtggatcatattttaaactggattacgtgttactggtttgggtgtgggttgtgaaccacaccagagatcactaaacttgcttcaggtttagtatctgactggtgtatggattcttaagcgccataagtcatttgagtatttgattatctgaataataacatgcaaattagcaagaactgggcatacagggtaagcggcaaggacaataaggatttttgtagatattatatattttttgtttttggttaaggagacaagtttgaagagcagacaaaatctcttttttaatatagtatgaatgagaatacttaaaaaaatttaaaaaata

SEQ ID NO: 8212 - DNA, 370 bp, Homo sapiens
ggtacatttttatttttttttggttgatgttgtttgtctttgaatgaagcatgtaatttattctcttaaagaggagaatacatgtggatctttagaaagtaggaggacatgtctaacatagatcgcttgtgtatattttagtctataactgatcatgcattacttagctgggcgtggtggctcatgcatgtattctgaccttctggggcaactgacgctggataatatttaatacctggatagtggatgatgcagtgagccacaatcacgccaatgcactccaacctgcgtgacagaccgagactatgtgtaaacatctacttcaaatatatgggcctggatgaatttaaatccgtggatggcgacgtac

SEQ ID NO: 8213 - DNA, 162 bp, Homo sapiens
tactcttccaattaatatctacattgatattcaccagatattgtgaactgataacactgaaataataagaattgcatagtatttgaagctgcatatcaataacagctttcttggtaatggctcctaatctatcttctttatggtgtggtctgcctcatattc

SEQ ID NO: 8214 - DNA, 178 bp, Homo sapiens
gatagggaaaagttagattattggaagattgtgtatacttattgatgaatatgatattaaaaatggggatgtagataaagaagaattgtgatttgaatgagaatattgagaatggattattgtattgagcttttagtgtttttttatttaataatggaaaataagctgttgtttagag

SEQ ID NO: 8215 - DNA, 498 bp, Homo sapiens
gtaccattttgcagcggagggcatgatggaaggacaagcgtttagaaagtatgtatctactctgtgatcggatattggtatgtaaggagtgctgctgtaactggaaccataagagggattatgcttacacaatgatctcatggatatgtgttgttagcatgagctgtggatgtaggattgtgtgctagaggaacgggtggagagattcttcaagctatggtgaatgatagagataatatatctgtatggcagaatatggacggcagaaagtatttctatatgacaatgattatttgctatgtatagatggtgacattattgcaatgaagctaggacgtgagcacgctaatcactaatgaatacgggattggctgcagcttgaccgtatgagataggtcccaacgtggcggatgcatagattgagtatttgtatgtgttatatagatagctaggtgtaatgatggatataggtgatagtgggtgaatatgttattcgct

SEQ ID NO: 8216 - DNA, 550 bp, Homo sapiens
  misc_feature (1)..(550): n = A, C, T, or G
caacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttangaagattcttccctatcagttaaaaagtttagaagaagaatgtgaatcctctctttgcacatctgcgttaagagccaggaatctagagctgtcccaagacatgaaaaaaatgacagctgtgtttgagaagctgcagacttacatagctcttcttgccttgccaagtacctcgggcgcgaccacgctaatcactagt

SEQ ID NO: 8217 - DNA, 162 bp, Homo sapiens
  misc_feature (1)..(162): n = A, T, C or G
gctgggcacgtaaggtnacgttggtgaatatctctaactcacggcatngtatatgcaggtattttcggtaccaaggacaaggttctaagtcatactattaaaggctaataaaattcaaaaatggtttaaagaattcgaacattttgaatgacgcagagggct

SEQ ID NO: 8218 - DNA, 530 bp, Homo sapiens
  misc_feature (1)..(530): n = A, T, C or G
ggnccgagtcaagcctgcgtatcagaatctgagacagcgtgttgacaactttgttgcaaatcacttggcaactcacacatggagtccgcatctcaataagaaccagctaagaaacaacattagacaacaagtcctcaaatcangaatgttggagtctggtattgaccgaattatttctcangttgtggacccaaagatcaaccacacattcagacctcaggtagagaaagctgtgcatgagtttttggccacgctaaatcacaaangagaangaagtggcaacacagctcccgatgatgagaaaccaggcacttcccttattacacaaagtgttcctactcctgggcccagtgctaatgtagccaatgatgccatgtcgatattggaaaccataacttctcttaaccaagaagccagtgctgctanggcttcaacagaaacatcaaatgccaagaccagtgagagagcgtcaaaaaaacttacatctcatccaaccactgatactaataaccctgccggcggggggtgga

SEQ ID NO: 8219 - DNA, 242 bp, Homo sapiens
gtccggggatgcacgcatgatggctggtggtggtatgttgaaaggataaaccacagccaaatgaaaacactattgatacaggttatggcgacgctgatataagtaaagacagacagcagggcacatgacacgacatacacacagcatggacggcaagcaggaatacagatctgattactgagatgtgccattattgatgtcaagaaggttcacatgatacagtgtatgagtgaaggtctcat

SEQ ID NO: 8220 - DNA, 290 bp, Homo sapiens
acatgatataagagaaatgttcctatggtatatatgaactcctaacactatgatcgtttttttttttttaaatgtgggtattggtgtgttttattttttgctgtttacttcttaactgaagacttgttgcgttgtaaaactgtttaataaaatatatggcattaacttgtatttacaaaaaaataaaagacaggctttacactatttctagggggacactatttcgggaatgttatgtaaaactctctatctagccattgggaccgatatcagttgattgggtatcgtct

SEQ ID NO: 8221 - DNA, 242 bp, Homo sapiens
aacaactccaggtgcaagtgaacaggaataaaaatgccatcgtttttactaatgaatttcacaaacatatataagcgaaataacaatggcagatgcctccactgtacttgagcaagtcatcactgatctgtttggagaaattagtggtgatgtcggtgctggctgtggcctgtttctgtctgattgtgaaataggtaggcctggttatgtactggtgtgtaactccaggtaacggcatattt

SEQ ID NO: 8222 - DNA, 178 bp, Homo sapiens
gttttatgcttgtgggttttttttttctctgatctaggtattaactaccaaataattcaaaacaccaaagaaatcatttgaatgggagaaggagaaacaggttgaagcactgacaatttttgcaagtgagaattcaaggactgtattgtagccacagttatgtacattatctacgaac

SEQ ID NO: 8223 - DNA, 354 bp, Homo sapiens
cactatattggccaggcttggatatatgaaacttgtgtcacttaaaactaaggcggtgtgtgatattaaaagaggtcttttacatctgtgttagctggcttgagaactcgcaactttgactatcttgaatgtgctgctggatggatggcctttgctctgattaggatccccatggtgaaccctgtgcccacagatggatccggatgcagtgcacttgtcgttaatggagctcgtctgaatgcataggagatgtggttcacacaacagtgcaagaaacctacggcctaggtgaggggaatccacttgcgcacagtgtcctctatctcacacccttgctcgacgactgcacagcat

SEQ ID NO: 8224 - DNA, 450 bp, Homo sapiens
  misc_feature (1)..(450): n = A, T, C, or G
gttccagcactgagggaagactcagtctctgccatcacatacacctcatcactaagaagagacacatgaaataattaccatccagtgtgataagtgctctgacagaggatggagtgaggactagtcaccttggggaagacagagaagcaaggtcccaccaagagatgagaagccagcctccangagtgcgctatctgagagggcaagagaaagaaggcaaaggagacgggtccatacttgaacaacttgaaataacttgtctgcatttcaagaacaacctaccacagaccttacctgtcaccttggctctcccacccaatggagatggctctaatggtggcacaaaccanggaagggaaatctgtggtttaaattctttatgcctcatcctctgagtgctgaaaggctgctgtnagctgtatgctgttaatgctaattgggatagggggt

SEQ ID NO: 8225 - DNA, 178 bp, Homo sapiens
aggggtaggaagtgaggtgtatggatatggaaatgtaatgaggtggtaagtaataggaaatttaaaggggaaggtgaaatgagttaggatgtttgtggatgagaagaatgttatagatatttatgatttgtagtgggaagttattgtattgttatattaattttataatagttatggt

SEQ ID NO: 8226 - DNA, 514 bp, Homo sapiens
ggtggcggagcttgaggtaatggtgaaggggtttgtgtgtctttgagagatagagattaatacatctatttataaaatataatcaattagttaatataatattgattaatgttaagtttgttacgtaatttttgtttattatgattttattagaatatatgaaaacttataagattataatgaagaatgaaaagatttaaggttattacatgatgacgggagttgtgatgagtctttttcatggaatggaagatgtattgaaaagtaatattgagagaaaggactgcagagacaagaattaataccaataggaaggcagtgctttgaaattataatgaatgtgagtgaatgagcttaaagtataattgaagagttgttagtgattaaaataattagaaggcgatcgtttgtgatgagatttaatcgaaagtgattattagaaattgaaaatacgtgaagagtggtgtattgagtttgttaaaacgttaagttaacgcattttagttataagcta

SEQ ID NO: 8227 - DNA, 162 bp, Homo sapiens
ggctcgctggacgcgcaggttactatggtgacttaatgtaattctaatgtactacatttataaattttggctatatgaatgtatcatcaatggaaatcgcatatctgtcaaggatctgctctttgctaatgaaaagtggtagagcaatggaacgagcgcttg

SEQ ID NO: 8228 - DNA, 290 bp, Homo sapiens
caggtaccggagttggatccggctgctagctacacggagtgtagggacactcaaggctcttacatgcgggaaccgagcacatcatcatgctgggtactttctggccacatcggagactctgacaattacttgatgctatgatctgactgaagacatgaagtaagaggtcactgtgactaaatatccagaagcctggaaggaggggccgggagctctcaagaatgggggacaagatggccacatgagggcagctctgtgccatatcggcacaaggcggaagaaagaccaag

SEQ ID NO: 8229 - DNA, 178 bp, Homo sapiens
aggtacataaaaacgctgctgggtagaggtcctgtggtgacagagtcaaaagactgcaatgttgatgtcacccggtgaactcctggtttgtgagagtgcatcgggattcaatatcatggaccttaatggagtaattggaagacctcaataaggaaaccattgagcctatggaaggttt

SEQ ID NO: 8230 - DNA, 370 bp, Homo sapiens
acaatatggttcgttcttttatatcgaaaaaagtgtaacttaaaaaaagtttatttatcgtataaaaataagtcttttacatctgttgttagctggtagtgaaaacttgaaagactcagactcagtggtaaacaggatgaatggtcccacctcgcctttccgtttgggagagggatcttgagggctgggacccctctgcgtcacagtaggttgagtgcgttgctggggcagcaggtttctaaaattttggccttcaaggcaaagccatagcaggggatggggtttcagcacaaccagtggcaagaaaagactaggggccctcggctgatgggaaatccaccttgtgcaccagcggttcctcacaactcaa

SEQ ID NO: 8231 - DNA, 178 bp, Homo sapiens
ttctagggtaaaggaaatatcataaaaactaaatataagcagaagctcaagggatctatgtatgaaagtgctgggagaataaaagttatggaagaggaggaaattctgaatcaaacacagattctttggtttctgggcaggattataagtgtgtatagagtgggaagaagctcatatg

SEQ ID NO: 8232 - DNA, 210 bp, Homo sapiens
  misc_feature (1)..(210): n = A, T, C or G
tatggntcagntcttttatatcgcaaaaaggtgtaacttaacaaaaaggttaatttattcgtattaaaaaaaagntctttttacatcctgntgnttaggctgggtggtgtaaaaacttgnaagcaactcagcacctcagatgggtaaacagnatggaatggttccaccctcgtcttttccttttggcagcaggatcgttgnagggctggc

SEQ ID NO: 8233 - DNA, 194 bp, Homo sapiens
  misc_feature (1)..(194): n = A, T, C or G
atactcgggnggnatggnggnctccatccggncctcgcggtccaccttccatcagatgtggtatcancaagacagnagtaggacgagtccggccccctccatcgtccaccgcaaatgcttctaggcggnacgtatgacttaagttgcgtttacacaccttttcttggacaaaaacctaactttgtcgcagnaat

SEQ ID NO: 8234 - DNA, 242 bp, Homo sapiens
  misc_feature (1)..(242): n = A, T, C or G
tcggagtctgntagcgaggtaaaatacgnacccagtaaaattgtcaatagccagtgtcttgtaattgttttggtttcggnttgttttctattagtacttatggtcagtctccggctgtattgcatacctcctgcatgcgtaggtaattacggtatgtgttttagtggagctgggtactttctaggggattttagtcgggggtgtatgtcctttgttgggggctcagctgctcctccctagtt

SEQ ID NO: 8235 - DNA, 242 bp, Homo sapiens
  misc_feature (1)..(242): n = A, T, C or G
ggtacaagagagtcatggaaagtatttgaacttgaacttaatagcgatattattaatgtgtgtgtggcgcacaatcttggcctcaaaaggtcatggataacctgagcatgctcttattacataactggttagacaatacgaccgttcatatacactgcttgctgtatccacggaaagcacacctgtcgcacaatgctctgaaacagctacttcacgttgtgctggacagctgaagangtgtc

SEQ ID NO: 8236 - DNA, 162 bp, Homo sapiens
agtacaattatatggccccagggatattgcggagggatgggtttaaaaaagtctttcggatataagaaagaacataggatgaaatgagtggtggagaaagggttacctatagaagactaattattcaaatacttcctctatctatagtatagtatattcata

SEQ ID NO: 8237 - DNA, 226 bp, Homo sapiens
gtgtacaggctggacacgatgatggatcacaggcgctggatccacgtgtaagccaggacgctcagaacaggcttggcgagggcgtggatgtgctcgcgatgtacgacaagcaccaggactcagagtgcataatcagcgtgcagacacatcgcacagtgcatgcttccggagtggagtaggactgccacatatgggagatcaaagatggcactgaagtaagcgaaca

SEQ ID NO: 8238 - DNA, 194 bp, Homo sapiens
gagtatttggggaacacatgtctaatgaatgccatccttgagtctctcataatcattgatcagtcatgctgttatctcatgcaactgcccgccgaggtagctaagaatgggttaacagcgagcagggcagacataccatgcctggatccaatgggataacaatgtttatttggcagactaattttactaagata

SEQ ID NO: 8239 - DNA, 258 bp, Homo sapiens
gtataaaaaattggagatgtagggggttgtagttgatgtattattatttgattttatattataatattctatttggtgttatataaattgatggggaggtgttttttaaatatttaaatttaggtttggattgattatgtttatttgtgagttgtgattatttttgagttgtgaagttttgtaatatttagtggtggagatggtgttttggtatgtgaatattagcttgtgtgggataaggtggagaatgtggttgta

SEQ ID NO: 8240 - DNA, 290 bp, Homo sapiens
caacctttttttttttttttttttttttttttttggtttttaaggggggggggccacaatggttaaaaaggaccttgggaaacagggaacgaaaaaaatggttttaacaaaatttgggaaccaaagtaaaatgggataatgggggttgggaagaagggaattggtttggtgggagccggctttgggctcccaattccttttttttgtcctttggctggggttagggaaaggggggaggcaaagggcaaagctccacccctgggtattaaaaaacggcagaacaaacatgt

SEQ ID NO: 8241 - DNA, 290 bp, Homo sapiens
  misc_feature (1)..(290): n = A, C, T or G
acatagattatctgggcgtggtggtctgtgtctgtgtaataccagctacttgtnaagtgtaggtgggatgatcaactgatccaaggaggacaaataggtgacaatgagctgtgatattaacactgaaatgcaaccggagctgcatgtgaacctggttgaatatacataaataaagattgctgcaccattggatgaagataggtgatttcatatatgacttgcggccagatgcagtaggaaacatatatctgtgacacgattctacggagatgactggagggagagtacgt

SEQ ID NO: 8242 - DNA, 162 bp, Homo sapiens
tactgtgttgaacttcattattcaatgtcattctatgtcataataacagaaaaccctatacaatcagagttgctcaatactggaccttcatgcaatactaggaaccgttacgctggtgcattgatacacgcacaccatacgagtcacaatgccaaatggaaa

SEQ ID NO: 8243 - DNA, 210 bp, Homo sapiens
gggaccgcagggtgcactacaacctacgaactacgcgcaccaccaactaccaccagctggtcgaacagacgcaagtatcatcacaagcatggtatacaacactgctcctgcgcacgaacacctctggagggacaccatgctgtatgctgctaggctagtctagtatcctgggatattcaatccacttaatctgagttatttagcaagtcc

SEQ ID NO: 8244 - DNA, 242 bp, Homo sapiens
tactcactatcggtgctggaatcagtttcatagaatgactagctaatagctgcaggtggctataaaagaaaggaatgtgcaacaaaggaaatgaatgatgtatatctacatatgataacactgacagcttgtgtaggtaccatggagaacagccgaataggctgatgtgaagatggtctgtgtagggctaaaatgactaagtaatgtgtattgtcaaggtatgttccaatacagtataacag

SEQ ID NO: 8245 - DNA, 178 bp, Homo sapiens
gtacacaggatatagacaataggaaaataatacctcggtcattaacaacacatatagaaggacaccagctgtatcgtgctggctatcacctacctgtatataattacttatctggtataagctgacaacatagaccttaagtgtaggtgggcaatgatgctaggaatctgtggaaggt

SEQ ID NO: 8246 - DNA, 162 bp, Homo sapiens
gtctggacaattcactgagctcgttctctctctctctctctgtgtgtgtgtgtgtgtgtgtgtgtgtgtgtgtgtgtgtatctggctttatgttgcattctttcccattgggccactgttctgtgccaacatgcaacgcaataatctgttacccacattcag

SEQ ID NO: 8247 - DNA, 306 bp, Homo sapiens
tacatgatggaaaggaagaatggacgacgatgcacgacgctgatgaaggcacagataatgacgaggacgaagtggggggacgaacgagggagatggatggtcactagaatagtatgacccctgtggtgggcgaacgagcgagattgacagacatcacagccgcatgcactctgcagtggcaacagatggaggctcaacagcattaaccacgccaagcctcgggcatgtaccagccggaggtgactcaggtgcataagacagcccacagttgaggcgatgacgtgggggaagagcacaagcgagaaa

SEQ ID NO: 8248 - DNA, 600 bp, Homo sapiens
gccggtaccataaagaaagtaggattaaaatctaaaaagacccccaaagcttttcaaaacctgatctgagaattagataagaatatgtcacttagaaagacaagcctgtagcacccatagctctgattaacctgaaagcatcaagtgactccctctttttccaccctaccaacatcactctaattatacttccaattagaaaaataatgtagcatttccctggcagtagagattaaatatgagttcaggaatcagctcctccaaacatgcataaatgaggacaaggagaagccagtcactcctgactgcacggtcaagtgtgtgggcagttgaaattaaggtaaaaacagtgaggctgaacaaaatcacattaagaaaaagcatctcatgaggcttttcgaggtcagttgatgaaggccagataggagtcaatattttctcatataccccagctgttaccactattcatattccaacagcctccagattgctcgaggccacctggttgacttttaccttggagtcggtccagaaaagcattatttacccttgtgatattgtcctcacagtacctcggccgcgaccacgctaatcactagt

SEQ ID NO: 8249 - DNA, 434 bp, Homo sapiens
caggtaccactatttgttggagatattgcacagtggaaaatgacataatcatggatatgctatggtgtacgctgtatatacagttgaaaactatggagttcgaaatgttgggggagaatgtgatatgagaaaaaagatatacatgtggtaagaacctctaacaaggttaatgtgcatgcgcgaaggctcatgaaagatcagtgtgtaaattggcttatagcttatacaaaaaaaaaaagaaataaaaaaaaaaatgacctcggatcgcgaccgcgctaatcactatgtgaattgacggccgcctgcgcgatccaccatatgggcatagctaccaacgcgcaggatgcatagattgagtattctatagtgtaacctggataggttggcgtaaatgtggtcgtatgctgtggctgagagacaattgtatccactcc

SEQ ID NO: 8250 - DNA, 258 bp, Homo sapiens
ggacgagctccagtatatttcgtagataaggcacagatgaaaatgacatagtcatccattgctatgagtgtaagcagtctgtacaatgaaaactatggatgttaaatgatgaggaaaatgccatgcgagaaagagagacatgtgaaactaacagctgacaaaggtaatgtgcatgaccgaggtgatgggagacttcagggtgtatattaccttctacataatagaaaacaaaagaaaggaaaaaaaacaaatacttgg

SEQ ID NO: 8251 - DNA, 434 bp, Homo sapiens
gcaggtgcaagggcatggtgctgagggggcagggggaggctgaggcagccgaaaacgcattatttttctctttgaatgataaagataaatacaactacatatacaatataaacattaggaaactgagacaaagataatggttaaggttataacgtaatcgtaatagcaaaagattataatagaaaaaaagaatacgaagactagtaacatgaggaaggagaaggaaaagagaaaatgaaacatgaccgtggctgaggtgaagatgattcatggagaaggaaatgtatatgaaagaaaattgagagagaggaatacggagacacgaaccaataccaatacaagggcaatggttttgcattaagatgaaggtgacggagacagataaaggctaagtttaaaagtggaagttgatgaaaataatagtaaggggatgt

SEQ ID NO: 8252 - DNA, 162 bp, Homo sapiens
cgtaggtacggccctccccctgtatgcctcttcgtggcagtaagcatggaatattgtaaatggtaggactccagtaattccttccagtggctctactatcaggctaggctcaggtataacccaggttatggcatattcgtaggtagctgctctctatgtctc

SEQ ID NO: 8253 - DNA, 546 bp, Homo sapiens
  misc_feature (1)..(546): n = A, T, C or G
ggcaggtgaaggacctgtttatctctgatttctggagttcagcnactagaaaccatcaatagatgtctcacaaaacatctggaacaactgaagacccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagccctaccatcttttacatgctccattgtgggacggccttgtacctcgggcgcgaccacgcctatcactagggaattcccgggggcctggcggtcggaccatttggggagag

SEQ ID NO: 8254 - DNA, 530 bp, Homo sapiens
  misc_feature (1)..(530): n = A, T, C or G
ccngggtgtaacatgccataccatgacccataacaggggccatgcacacccatcagtgaggaccttcggcctagccatgggacttcagtctaactatgtgacgctactcatactaggtatagtaactaacacaatgactatataccaatgaagacacgatgtaacactgaagagcagatgccaaaggcacaagacaacaccagtgcaaaaaggcaccagatgcgggataatgctatcgattacgtgagatgttatttatttcgcaagatgtttctgagtctgttagcactccatgatagtctctacactccaaccaagagggcactggccaactacgagggtaacggcgctcaacacgctagaagccgcactactaaacacatgcgcaacacttgcataaagaggatcaaccagcagagcgaaccatagtcaaatgagaaaaacacgaaaccatacaatacaagcgctgcttaacacaataagaccgggtcattacaataccactgtgcatgcatcatagcctcccgaca

SEQ ID NO: 8255 - DNA, 274 bp, Homo sapiens
cgggcaggtactcaccgtgcgtgacactcaagcctgacttaacacagtgcatgtcatctgatctacaagaagatacagaactggaaatgaaaagacatgtggcggactatcgggcaatggtggaattgcataacgaacctgtctagtgagtctagcgtgatgctccataatgatgcacacttggtgcatcatagaggtgtaagcaggaaccaagaaccagccagcagtgtctacactttgtgattggacacttgggccggggaacacgcctcta

SEQ ID NO: 8256 - DNA, 418 bp, Homo sapiens
agcccccccccccccccaccccggccccccaaaccaccaaatgaagggcacgggaggaggacacacaacacgcccagacacacagcacagcaggggccgcgaaacggagacaaccccccccccacggccccgagaagaaaaacaccacgcccccccccacgaacaccaccaaaaaaaaacaaaccccccacaacaccccccgggacccacagcccaagagaacccaccggagaaccaacaaccggggggaggcggaggcaggccccggggagcagggaggaaagcggacagccaggggaggccgcgacacccccgcccccgccgggaaaggcaggcggcggcaagcagcaacaaggggacagaagggggggcaggagcggccgggagccccccagcaaaaccaaccacaaattccggg

SEQ ID NO: 8257 - DNA, 450 bp, Homo sapiens
ggtaatatgatgaataataaagatgatgcaaacacagaacatacttagtcagacatagatgagtacagatagatgttgaggtggctggggagtcctgagtggggatgttggagaatgggaatacgaaacagcatgctctaataatggacacactgggagagatgcaactaagggttacagactgcaagatgagacaacaatgagccagcgtacacacaaaagatataagaggaacacgctacagaaatcaagcaataagatgaaaaagatagggtacaaaccacacacattaacaaaagtggctacaactgggaggaatggagacaagaggctgtatctgggtgctaaggtgacaagatgcaaggagagggaagtcacatgcaatgatggaaaggacagagagaccacgctgatggtggctatggactgggtaccaccatgatcgtagct

SEQ ID NO: 8258 - DNA, 162 bp, Homo sapiens
ggggacaggatacggaggagaactcaatagcatggtcactggtgtaaattctgcattgtagatacacgaagcagcctttacctattactggagcctgccttcactaacaataaatgaaaaagctgctatgcacttctacagcaggctctgggattgtcatat

SEQ ID NO: 8259 - DNA, 178 bp, Homo sapiens
gtaccattggtggccaattgatttgttggtaagggagggatcgttgaacttatttgatatggaccggtagcgtagggctggggacggggacgaggagcacgatgtaggtagggacgatacatcataccgcttctatttgctgcacgactgaccatgatagtactagccaagtgatggt

SEQ ID NO: 8260 - DNA, 594 bp, Homo sapiens
aggtacacctaagttcacatgaagttgtttcttcccaggtcctaaagagcaagcctaactcaagccattggcacacaggcattagacagaaagctggaagttgaaatggtaagtgaaactgtatccaagtaagcaggtaactgggcaaacttcctacggcacaaatggctttttagttacctcctagtgctgaatgcattaaataaatggcggattcttgtcttgttatgattaataagaaagtttgtaaatgcagcctggatgatgataagcaaatgctgactgaacatgaaggtcttaattagctctaactgactaaaggcatttgttagttttggcaggggatgaacactcatctgtggctattctaagaccactcttatttcttatgtggagtccaacttgcctggaccagcttaatggttctggtaagttttaatgaaaacagtagatagacttaatgaaaatgctgatggtgatatgcttactgctgagctaatggcttaaagcttggctgatgaatactgactgtattttccttgagcatgtgtggaacagcggttatgtgttctccttgaccgtggttgggacggg

SEQ ID NO: 8261 - DNA, 674 bp, Homo sapiens
gtaccttgagaggtgtcgttaactttccttgttaacgaaaacagtatatcacattttcttgctgattaaagttattaattcagagactgaaggggctggacttgctacctgtatagaactgtgtgtaaaggctcttcgcttggagtctacagaaaatactgaagtgaaaatatctatttgcatgaccattttatgtttgttgcctgatgatctggaagtgtaaacgtgcttgtcaactgagtgaatatattattgagtctacagtagatgcgtattatgctgtggaaatgttgtataatcagacagaccagatatatgatgaagagaatcttcctataccaaattctttacgctgtgagctgttacttgtattgaaaactcattggccctttgatctagaattctgggattggaaaatcttgaaacgacaatgtcttgcattaatgggagaagtagcatacattgtgtcttcaataggatgaactaaatgacagtgaggatatgaaaaagtggtagactaccaagaagagagtaaagaaacttctatgaatgggctttctggtggagtggtgctaattttggccttcttaaggacttggtgatgaaaagacaaaaaaagagaaagataaaacaagtaaaaaaaaaagggattaatatgtgcttggattatgtat

SEQ ID NO: 8262 - DNA, 324 bp, Homo sapiens
ggtgaccatgtgagatgtggattaccatgagcaaaacacgacgaatgaggacacctctgaaatatatacaaagcaacatactgatgattgtgataacgtgccgtaaatgtaactgatctctctgtcaccaatgacgacagaggaggcatataacacaaatggcaaataagggtctaggactggaggatccagatgagactgaatgaatgctataaataatcggtggctaccacgcatatgaatagagaatcttcgtgcgattagctggttaacaatattggataaccttcatacgcataggaaggatatgtagtaaattatatt

SEQ ID NO: 8263 - DNA, 194 bp, Homo sapiens
aagcttggtatttagttttttttttttttttgtgggtttagagtggctcaggggggcgttaaggtgtgccagactgtacgcgcatagttcagaaaaaaggggcttgaatttcatgtgcaacttgggatggggggaaagggggacgtttgagaaggagggaaaacagggggggaatatttttcaaatcaaccttc

SEQ ID NO: 8264 - DNA, 194 bp, Homo sapiens
attggggcaatctcaaaagtagtaaaattttttttgtcttttggcttaactctacagtcacagcagaccaagtttcagcttacatttaataggcagaaggggagaaaaaaaattgacaggaatgaaagtgcgtaagaacatcacccttagaaatcaattacaaggtacttacatggaagtagaaaaccatctct

SEQ ID NO: 8265 - DNA, 226 bp, Homo sapiens
ataggccgggcctggaggcgcatgcctgtggtgccacctgcttaggatgctgaggccagataaatgattgagcctgtgaggcggaggatggggatacattgttgattagctagatgagcttgaaaatatagagataaacaagatcctagagtgcatgaagttggcatgagaaatggaatttgtttggtggatgaatctgaaacataatgttagtgacagtaaaaag

SEQ ID NO: 8266 - DNA, 162 bp, Homo sapiens
aatctatgactgcatacagttactaatacaaatattaattacaccacactttggaagtataaaaatggtaaggtaatggtgtgtaattgagaggatgagatgagaggatagtttaggccgtgtcttgctgcttacatgaaagaagacttgtaacaatgaatt

SEQ ID NO: 8267 - DNA, 418 bp, Homo sapiens
tgatcagaacacatcagattagctacagtgttgggattatgggtgtgatctattgctgacggattgtgatattgtttgtgtcattatttggtcactttgatatcgtagattattattgtgttgtgttaatatagtataatatgtgtattcaatcacaaattaaaagacaatatagttgttatcatcaacagggaatgatgaggaaggagtgtaaggagagatcagagactgcaagagaataagtgcagagaagccagcagagataattatatatgtattatataagtatcagtgtatgtcgtggttttcatattgctaggtagattcataaaattgagatctctgtgatactatagggtatatatgttcaacttgatatgaaactgtgatgtgttttccacagcggatgatacggccc

SEQ ID NO: 8268 - DNA, 434 bp, Homo sapiens
cgggtatattcatagttaagtgataggtacaattaaaaattcatggcatgtgattaaatatctatcgacacatgctctgtttattatgtaattctgatatcttgaactaggatgtggatgtggattgtggtctgataggtatctattggatactactaccaggttgagttgttcatgattgacatggaaaactaccaattgttataacatataataatcatctatacttacatatgggatggttcattagggtcgacaggtgtgtgcagtgtcccatgttagtaatctgacttaatgtgaaatttatgacccccccttggtgctcctatgtggttagtggatctattatattttctttctgtttggcttttctcttttttctgtgttataaccgttgtgcggtctggagaatagtgactattttgtgtctgttt

SEQ ID NO: 8269 - DNA, 306 bp, Homo sapiens
ggtctaattctctcttttggaatgtagattttttttttaccatgctttacgatgtaaaatatttatgttttattgattcctggatatctggctgagggattatacatggaacaggaagatgcgtggtgactattcttgtcggtgatgttgagagtctctcgtgactgtcatattgtagtggtagatcatatattcactctggtaggccgtgacttttaggcttagttcagactgtgtgggcggcgctctagatgacttgtgtctgcgcgtctgtctggaggacagcactatgggatagatcctaat

SEQ ID NO: 8270 - DNA, 290 bp, Homo sapiens
tgtatattctagaagctgataattccagttctggcgaactaggaagattagagcaagattctcaatcagcgtatgatcttcggagaggtgtgggaatgtgttatataacattcatctttcggtgtgctcttggactaatcaacttatcttccataagatgtggttatgggttctgtattagtggtggaggtgggatgagacgcacttaatcatgatgaggattaatttagatattgggtgtgatagtgtcttgagaattgttaagcactattatgtaatagctatttgat

SEQ ID NO: 8271 - DNA, 178 bp, Homo sapiens
gaggctgtcaatggtgttagagaaatgagggctccctaaaacaatttctttatgtatatgttagtcaaaagttatcatgctgtgactatagttatagcgatgaagatgaagaaaaggcagatgctttgatcagtttactcatacaggaagggatagacataagtgacctcttcatgcc

SEQ ID NO: 8272 - DNA, 194 bp, Homo sapiens
cggagggataagaaggtaagtaagataatgtaaaataaaaataagtgatcaaaaaacatgtaaaaaaacaaatatatttagagaacataagttatgttcttgttgtggtggtggaggtggggagttggtgaggtggtttcatcgtcaaacgaaacagcacgaaataataaagaagaaaatacaccaaaaaacaa

SEQ ID NO: 8273 - DNA, 258 bp, Homo sapiens
ttgatcgagaagatgagaatgtggcttgtgatttacaaagaatattaggcttatagtctcagtaacataatgatcatttgaaaggtatatgaatgtgttggataacagtttacatttgagtgtgcttctctataacatgattgatctaccctaatattatgattatgtatataaggattgggacatgtggatcaggtgtccggtattgatggtgacgatgatatgtgattatgggtgtgagagtgaatattgaaatgg

SEQ ID NO: 8274 - DNA, 498 bp, Homo sapiens
aggtactaggaaaaggcctggctgccatccatcgctgcctctgagggtggagaaggaggcgggtgatgtgctcacttctgatcaacatgtgttgcctcctctcagccaacttctagctcactgcactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccaggggggtcagtaagctctgcctggcaagaagacacagtgagaggggtccacagttcctgatgagggtgggtgtgggtacttgtagaccctaacatgggcaggtctgggtcacctttagaaactctcagagaaact

SEQ ID NO: 8275 - DNA, 258 bp, Homo sapiens
ggtacatataatacagtctgtcaagagaactactggttaaccaggaaaacttggcatgattctcagcgatattgtgttctactgaaaggtacaggaatgcatcagataaaatataaagtgtgatgtgctcttgcgacagcgtcacgcatgtgccctaagatttagttgcttggatccgaaaagagggcggtgtggcattaggctcctgtaggcagtatgaggatgatatcaaatcatgggtgtgaaccttggctgctg

SEQ ID NO: 8276 - DNA, 242 bp, Homo sapiens
gccgccccgcggccagggtacaatgacacctttggggaaggaaaagaaagactaccgttctcaccccctgaccatttggtattagcctggctgccctcaaaaacttcccacgctcccctcccctgcgccaccctcctaaagatgacctggatactacggtgcctgcccccaccccagttagcctccccctactccctgggcctacggagcgcgcacagggcgcatgtacctcctaagaaatt

SEQ ID NO: 8277 - DNA, 162 bp, Homo sapiens
  misc_feature (1)..(162): n = A, T, C or G
tatattaatatntgaatgtcgttgtgattcttatggtactgtgatatatgctatagaaagatggattggagggtttgaataggttatggtatagtcaggagagatagaaatggtgtatgggaaatggtcgtggtatgatatgatatgttattctgatcttca

SEQ ID NO: 8278 - DNA, 402 bp, Homo sapiens
  misc_feature (1)..(402): n = A, T, C or G
atcatgaaatatactctatccctcttctgcttaatatagatctgatctcatactgacttagaatacaatgatatatgtagtgtgtgagtcgtgcagtggcaaggtcaggaatgatagtgatataggatatagtcttgtcgtggtgacgggatattgagtttctattatctaacttagtgtcacaatcttgaagaagtgaatagtttgaatcagaccagttatcattcttgatggaggaaaagggatgatganggtgggtgaacagcatctcctttgctgcctctctgcctccactatcctgtccccatgaggagcggaagaaccgttatgactgatgagtggttcactgcatccctttctcctggcgtggtcttggctctagctgcactctttaggggcaga

SEQ ID NO: 8279 - DNA, 274 bp, Homo sapiens
tgtattgaagtaccaaatctattgatgtttggtgctgataaagaatgtagactgtagagactagcagtaattacttgttctacttaatgatgtcctatgttttattctacatgcaaaaagaatgattgatcttcgagcattgttaaatgttgtgggcggtaattattgtggacagatgattcttgattttgagtctatacagatgtgcattattgctgtggaaaggcacgaggcagctgtgtagctcttataaataaggatcaaatattagctt

SEQ ID NO: 8280 - DNA, 194 bp, Homo sapiens
gtgatgaagttaaaattattgagtgggtgcagaataagagtgtatacagtagagaatagaagtaataatatggtctacttaatgatgtcctatgtaatattcgacaggcaaaaagaatgattgatcaccgagggatgataaatgttgtgggcggtaattatagtggacatatgattcttgaattagagttatgg

SEQ ID NO: 8281 - DNA, 178 bp, Homo sapiens
tttggatgtaggacaactcatttgagaatggtatgatgaatggattgaatctactgggtgataaatatgcatacaagtgaccagctacttggcgtcaattcaaaatactattgataatataacaaatcccaagatggcatggtacagaaaagtggatgatgtgcatacttaatgttca

SEQ ID NO: 8282 - DNA, 162 bp, Homo sapiens
cacagcagagggcaagcggacacgacgaagagacaaaagacacaaaacaagaaacacgaaaccaaaaacaacggccaaacgcaacacaacacaccaacacaacaacacacacacacacaaaaacaacacaacgcaacaaacaaacaaacacaggacacaggc

SEQ ID NO: 8283 - DNA, 242 bp, Homo sapiens
gcaacacgagccccatacacacagcaccggggcaaagcgcagagccggacgggcaccgggcgaccccgcgccccgccgcagcaaaaacaaccaaacacgggcaaaaggagaccctaacaagccgagaagcaaaacgtcatcacacgccaccccctgcgcaaacccgccgggaggagcacaacaagaagcacccagacgccccagccaaccccccagagccccgtaacaaacgcccagagagg

SEQ ID NO: 8284 - DNA, 530 bp, Homo sapiens
  misc_feature (1)..(530): n = A, C, T or G
gggcaggtacaagtgtgcagagctgggccttcattccacaggacataatgcatggacaatataatgttctacagaaagatcatgccaagaccagtgatccangaagatcatggaaaataatgcacatcagtgnaacaagagaacccatagagcttaaatgtgtgtctgtgacaggattcactgcactgtttacttgggaagtggaaaggatgggctataccattaccctctgggatttggagacccagggcatgcagtgttcttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattgccatacatgcactataggccgggatagaaaatcgtcagctggacacaggaaatttctttttggagagcaag

SEQ ID NO: 8285 - DNA, 306 bp, Homo sapiens
acaccaaaaagtaaacatgcaaagagggccgaacaacagtcataatgataaggtctgagaacaaaatcaggagaggatagtgctaaatggctgacaggatattagccatacgacattaactacatctggtgaggaggctacatgactggagaggcagcaaacaactggaagccaaagaacacctcaatgcatgactcagaggggatagcagcagaatatactgcaccctcggatccgaactaacatcaaggatataggcctaaagaggatggagcttctaagatgttatgaactggtacgagagca

SEQ ID NO: 8286 - DNA, 194 bp, Homo sapiens
tgagaaggcgccgggcccgggactaggcgtgagccggggagggtacactggggcgcagctctgcggcactcgtctggtggtaataaataaactaaaccatgggtcacaaggtacgatccctaatgaagctccgagtaggacaaaaatgctcgatgatgatgtcacttccttctgttgccagaactttgcgtcgt

SEQ ID NO: 8287 - DNA, 178 bp, Homo sapiens
cagttgcagtagtataaatccgaccgtgcctggcccagcaggacccccaggtggacctgttgaccaaaacaccagcatctggggccgtgtagtacaggtaccctgtctgaacgatagttccaaaaaactgcaagtaagtatggtgggatatagaccccaccccactaacacagtgttt

SEQ ID NO: 8288 - DNA, 194 bp, Homo sapiens
tgtggtggctgtataggcaagttctagcagccttcttttccgacaggtccctttccaataccaaccgctggttgctcacctgcattaaccacccccacgtgcggtctgtcttgggggaagtggaaatgggtggagatgatggcctgagtgttggatggtgagaaaaggtttgtcgaggaggacgcgtaggcgta

SEQ ID NO: 8289 - DNA, 210 bp, Homo sapiens
agcttttgttttttttttttttttttttgggaagggatgatgtgattttttcttttataacatgatttttaaagacattatgcatgggggtaacattcccttgaaagggggcttgcaagggttatgagcctctagccgagctggaatctggaggaagaggcagagaagcttggggaaaaagaggcaggggaggagggggggggcataagg

SEQ ID NO: 8290 - DNA, 162 bp, Homo sapiens
tgggtgataagggtagatgtattattattgtttttgattttgatgttgtgttttttaatgatttgattatagggaaatattatgtaaaataagtgtggataacaagtattgaatagggaaggggatggggattgtgggggagagagtgagttgatagtgagt

SEQ ID NO: 8291 - DNA, 162 bp, Homo sapiens
gttgtgagggttgggtggtgttatttgtaaaaggggtgaaggtgaatttagaatggacttatttgttgttgtgtttaggaggttaaaataatataaatgaaagagtggaagaatagtaaaagtaagggggaaggagggataagggattgtggtttggtttgt

SEQ ID NO: 8292 - DNA, 514 bp, Homo sapiens
accgtttttttttttctagagtcagtaaatataagcttgagttgaaagactttacttattcctgctgctacaatttaattctctaataataatattatattcagagtatggcttattaagtacagggcccacatattgaaccaagttcatgcagatttggattgaagttaatactaacccaattacaggttgactataacttgactcttaaatttgatattatcttcaaaattataaatagattacagagatttagaactggttataatttagtaagattaactttgcagtgttagaatttttagcaacaaatttttagaatttttttagcaaaaagaggaaatacacattaacaataaaatatgctagactggctctgttggctgaacagagcatcatgtggttaaagaactgtagaaacgggcttaccaagggttgaattctacccactgctctccggtgatgtagctgtgttatcctctctgctgtattctcgggttctcttagggtcatt

SEQ ID NO: 8293 - DNA, 210 bp, Homo sapiens
gggagcgcagggagctgacgtctttccgttacaaccctgagttctactctggcattggggactgtgaggtacacatactcaggtccagggatggaggggtggtcagggacgctataggtgaccttctggttgtatatacgggtgtgtgcttaacagccaaagtttacctgagtccgttttcttggggtgatgaacagatgctgtcttgcc

SEQ ID NO: 8294 - DNA, 242 bp, Homo sapiens
tctggagtcggcaggatagcgggaacagccactgggctttggggaaaggactcgattagtagatcgagagtattcgtttctatgcattatcaccagcgcggcatgcatatgttctaggggcagatcattttatatatctgagttatttaggttgattcattgcaggggtctagttacatggaatgagggtagacatgagttctgtaattacatgagagtaggtaatggggctttcttcagag

SEQ ID NO: 8295 - DNA, 258 bp, Homo sapiens
gagtgagcatacattaggatagggatggatgctagtctaagtattgtcgatgtgcttactactacctcctgtgatcgtaaaggtgattgatatataggagtggtcttgctatgtacgtgtatgagacagagtggatggtgaggttaagaagatggacctgttgcgcgccgttttgcacatggtatagatagatggtgatgagtgcagaataatctgatgcttatgtgaatgagtacgagctggatttgtacagccggt

SEQ ID NO: 8296 - DNA, 354 bp, Homo sapiens
ggcgcaaggcagcactggtggtgccggcattcgagaccctgcgctaccgtttcagcttcccacaattgaaggtggagctgttggcgttgctggatgctggcactctctacaccttcaggtaccacgagtggtcccgaggcctcgcatcttacagactatgcccgctggcgggaggctcaggtcccgtaccgtgtgcaatgggcggcccgctatgaactctacgtggtggtgccacgagactgtccccgctatgatcctcgctttgtgggcttcggctggaacaaagtggcccacattgtggagctggatgcccaaagaatatgagctcgtggtgctgcccgagggcctccgcat

SEQ ID NO: 8297 - DNA, 162 bp, Homo sapiens
  misc_feature (1)..(162): n = A, T, C or G
aaaanaagtaccacctgagtcagtgagggccacagattggtattaatgagatacgaaggttgttggtgggtgggtgtgtgctggagctaagtggataagaatgtagtgggagtggaggtaagaatgggtgggggtaaaggaagggggatgggagggcggggg

SEQ ID NO: 8298 - DNA, 354 bp, Homo sapiens
tcaaatgtagagtagagagggaagggaaggagaaggtgggaagtgaaaaaagaagatgaaaggaggatatagagcagaaaaaagaaaagatgagtatttgtgaaaggggaggaaaaaaagaaaaaaagattgaaaaggaagaggatttattgtatagaagtaattgaatgaggaaaatggtgtgtttgtttgatttagatttgtatattttagtaaattatagttggggttagagaatttgtatgatataggatgaacaaaaaagggttagagagagttatatgtcataattctgaatttaattgtggtgtggagatgttaattaattatataaaggagaaaataagttgttaa

SEQ ID NO: 8299 - DNA, 194 bp, Homo sapiens
tcagtgtatgacccgtgaggtgcctgagcgtatttgacgcgtttctgatgattctgcgggaacagtggtgcatgtgccgctagaccggcgagctcggcgacttgagtgatgacgacttggacgtggtgtccaacgacaaagagaagtgtaagacgttagccggacacgtctgagccaggagggaggtggggttg

SEQ ID NO: 8300 - DNA, 226 bp, Homo sapiens
tctggttactatgtgacctcagggagaagttagtaagatattgtgcatacacgttattagatgggcgtacaagtgcatacaagtgataaaagaagggtgagaagagatgtctgaatccagaatcgaaggcgatcaagaattactgaaagcagttgagcgaggagaggtaggtttgatgtagccggcagaagaatcgctatttaggaaacggcaaactgggagtcgg

SEQ ID NO: 8301 - DNA, 533 bp, Homo sapiens
  misc_feature (1)..(533): n = A, T, C or G
tacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaangagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggcttcgacaaggcaggcgtgagc

SEQ ID NO: 8302 - DNA, 594 bp, Homo sapiens
tcaggtgggcgtcccctcttcccttgcccttctctgcacggtaactccgtccctcggcatttctcaataccccttgcccctagatccaagcctgtctcttgaggaacaaccgcgcagaccctgcctcttctgaccacacgacccgccttcagccacttggtctggtctcagacccctcagagcaggaagtgaatgaattgtgtcagtcggtgcaggagcatgtggagctgctgggctgtggggctgggccccagggtgaagccgctgtgcgccaggccgaggatgccatccaaaatgccaacttctctctcagcattctccccattctatatgaagctggaagctccccaagccatcactggcagcttgggcagaagctggaggggcttctgagacaggtgggcgaggtctggcgccaggacatccaggacttcactcagggcaaactggacacagcaaggagcctctggccacagatgctgcagggattcaggtggagggaggagatagagggggtctggcagggtgggaggggctcccggagctggtcccagagcaggggtgggagatgccttgtgttagctcagggagatg

SEQ ID NO: 8303 - DNA, 178 bp, Homo sapiens
aggaggaaggtggtcggtgtgtagcaagatagtagagagaactatgtcctgatcctctgataggaaatgtgaagacgggatgttttgatgggtcccagggagctactgcttggtacaggccccaggaggagggccaaactctggacctcatttctgcagtgactaatctggatgtacg

SEQ ID NO: 8304 - DNA, 178 bp, Homo sapiens
gggtgacatgtcagatctttgtacgtaattaaaaatattgtggcaggaaaaaaaaaaaaaaaaaaaaaaaaaaaaaaaaaaaaaaaaaaaaaaaaaaaaaagaaaaagaaaaataagtaagggggccggagggttattccctttagggagggtgaatgtttagtttggaggtgggcgg

SEQ ID NO: 8305 - DNA, 642 bp, Homo sapiens
agtttcttctaaggcatcaagagccccaggctgaaaagcaccccagagctggagcttatagaacccagggcagcaggttctccaaccttctgacatcatcagagcacagcagacaagttatcagccactagatttttttccccctttctgaaactgtaacctttcattccagccattccccagagctggacagaggacgtggctggctggctggtttctgtagtcagaatgacagttgggtgatagatctccttcgtgaagcaatgtcttagctcagtaactctgcagagaagctggctggttcaggatgtggcttatgtaagaagatggccctggcgttttacgcgcactggtgggtgaggctctgaaagtggtagaagggaattctttcctagagttcagctgcccgctgtcctgctcctcaggggaaatgctgtgagatctgcatttagcctgtgtgtgctgattgtggttctgccgcttcctggctgtgtgagctcagacaagtcacccaccccctctggggcagtttcctcatctggagaaggggagagtgccccacacattgggctggttgtgtccatggagtggctgacaataaccagcacacacgagacatcagtagcaggtgggttcttcccc

SEQ ID NO: 8306 - DNA, 546 bp, Homo sapiens
cgttcttctaaggcatcaagagccccgaggctgaaaagcacgccagaggtggagcttatagaaccgagggcagcaggttctccaaccttctgacatcatcagagcacagcagacaagttatcagccactagatttttttccccctttctgaaactgtaacctttcattccagccattccccagagctggacagaggacgtggctggctggctggtttctgtagtcagaatgacagttgggtgatagatccccttcgtgaagcaatgtcttagctcagtaactctgcagagaagctgcgtggttcaggatgtggcttaagtaagaagatgggcctggcgttttacgcgcactggtgggtgaggctctgaaagtggtagaagggaattcttttctatagttcagctggccgctgtcctgcgcctcagggcaaatgctgtgagatctgttttttagctgtctgtgctgattgtggtgctgccccttcctggctgtgtgtactccgacaagtcaccccacccctctggggcgggtttcctcatctggaag

SEQ ID NO: 8307 - DNA, 370 bp, Homo sapiens
atgctcgattgtgtaccatgtactggagaaaaagcatcaagttcttaaaccatgtagcttcgtaccttagtacgcatcctctatctgtggaggctcaaccaattattagccagcagacagtatatgcattgaaaatggcctaatgtcatataactgatgggggtggaaacaggatggccgaggaagctgtgagggtggatagagctggcttatcattctgtgctgtcttcatctgtccataccgcttccaggttgcatcactctcacagcgtgtgagtgacagtatcaggatggttgccggagtctcatgcgttgtgtttatgtataaagggtgcagagagattcactgaaacagatactaaaggataac

SEQ ID NO: 8308 - DNA, 450 bp, Homo sapiens
gagtgagactccggtggcaggaacaaaaacaaagaaaaacgacaccaaaaaatataaaaacacatcagcttgacattttggaggcattcccagactcagggttagtcagcagattagcatttaagaagaaagtcttgtccctacagattgcctgacctcagctacccatgaagggtgggaagaggagtgctgaggaagaagtacaggaaggggacaacctcctcagacctgataggacactcctgtctccaccctgcctcctgactgatttactctcgggggtgtgaggacctctgagataggcgccaggagtctcacgcgcggcactgatgtctcaagggtgacccgagagtcgctgaaacagatactagaggaggggcaggtgataggataaagtgagaggtactgagacttgctggcgtgggtgagcggctccgggggggccgaacg

SEQ ID NO: 8309 - DNA, 642 bp, Homo sapiens
gccgccactggtcgaactccattgtcggggggcctctaccagccgcccctggcgaagtccattgtcggggggcctctaccagccggccgtggcgaactccattgtcggggggcctctaccagccgccgctggcgaactccattgtcggggggcctctaccagccgcccctggcgaactccattgtcggggggcctctaccagccgcccctggcgaactccattgtcggggggcctctacgagccgcccctggcgaactccattagtggggggcctctacgagccgccccggtgaactccattgtcggggggcctctataaggcggcccggtgaactccattgtcggagggcctctataatgcacccctggcaaactccagggctcgactcaggtcggatcgagcccgctctggggtttcactgaaatcgtcagcattttcagagacagcaggagccctggatgaaaggaagactggcacccttgtgtgggaaggaccctcccccgattttggaacagaggaggcagagctcctcctgaaaggtggcacctgccccggggctctcctggttaccccggagcaggatgaggccaggaggtgagcgatgaggccaaggttgttaggaaaggaggggcagctgggt

SEQ ID NO: 8310 - DNA, 370 bp, Homo sapiens
gaggcccgacctgggaaggctggcgaacgctaaccggagggtttttcttccagacttgattccgggatgttgagatcgttattcgaaatagactagcattcgagtcgcctgtgatggagggagttcctgcaccgtaggcctggcctcatttattctgcaaatgtttattgggtccttgccctttacaagatcctgtgctgtgagcaggatcagggctttcatgtggaaataagtcggcctttggttgaccaactgaaactcctctgaatggaaaatcaagaaatttttggaaaacttagtaaaatgttcaatgagttgcatataagtattccttgtttaggtagcctggactttgtgaacttgagattct

SEQ ID NO: 8311 - DNA, 434 bp, Homo sapiens
ccagagcgagactccggtcttaaaaacaacagcaacaacaaaaaagatttgatgcctctgatggagctgaacatttattatacagcaacagcagcaaggattgctggtgggcagactacactgtagggcatctggtcttctgttagagtctgaaggacactattgtcagagctctgcccttttggaatgaagaaataattcccagatccaggaggggaaacaggtgttggttgagggtcctggcagcagcttttctggcacagtcgagacttgggaggctctcccggaagggggcatcatggagctgagcctgcccactgggtattccattgtctatgaattgaacaggaggagcttgaagcccattgagctcatgcaggtaccaggagacgaagagggtgtgcataaagacatggaaggggtggtggttaggg

SEQ ID NO: 8312 - DNA, 482 bp, Homo sapiens
cacgtttcacagatgtggcaactgaggctcagtgaggtgacctgccaacatcctcaggctcagcagttctcaagcactactgcccactgtacctgattgcctgggtctgcgcctgggcccccgcccttttacaaaagggtcacggcctctcaagagctggacatgaaggatggggcaagtccagtcttgatcggtaatgcccacttgacactcccaggagcagcatcatagcatttatacaactccttgtctcattcccgatgctgggcacacaggccatatcagtggactcccctcacccgtccattcagttacaccacttaagcctgcccatgaagacaatggctaaggtgacagttggttacataaattgaagatgagtctctcctccagatgcatggtccgtgaagaaatttaatagcaaagacgagaagaagatacaagtctttaatagttctctgggtattttctcacccaaacag

SEQ ID NO: 8313 - DNA, 466 bp, Homo sapiens
gacatgccccaggggacatcagaggtctctctgcatggggattaacaggagaggaggaagccctgacatgtccaataaactcaatcatctggaagatagctcagtaggtgtatccttgacccagcattgtgggagaagatatgtctggaatgtgtatatctgcggggagtgagaaaggaatgtcagcagtcaggatgtctgcagatggggaattagaaatctgtcttagtgttggtgggagccagttcaaaagagacttcagaaggattgatggtttagacggggtatctatataggacctgtttagattaacttcagtggaatgagggatgatgtattaggataatatagttagctgtaaccagcaactgagctgtaacaaagccactgacacttctcactcatattctatagtccagtgagggtctaggggacagggggtgctctgctccctccattctttctg

SEQ ID NO: 8314 - DNA, 322 bp, Homo sapiens
acagtccggtaccagatcgccccatctgccatcaagaatcaataccacacactccatccacaccactcccagccctgagaggggctctggccagctctgctaggtctgagctgtgtctatgcccggatgtggcagataaggagaaccatggtaggagccgtaagcagctgtgcgcaggcagccagagggtctcgagggaggaaggcgagcgggcgggcggagcctggcggcgggccacagcttcaagagcccaagccagcggtgcggctatccgggggatccatatagagagggaggtgcggcgcacggccatctagagggg

SEQ ID NO: 8315 - DNA, 562 bp, Homo sapiens
gctgcagccaagattctgggggctggggtggcgggtggaggtggggttggagggagcgggaggaagcagccagaactaccaggcggcattgcccagcttcttctgcttggccgcctcccccgccagccggccggctatttttggcatcttggcagctgagcccccctcggcatccccccaggccccgtggcccaaaccaggttgtgcgtctcctcacggttcccactggccttcgatcctcatttgctaaatatctgcgaaggcagctcccgcctccccagtgcctacgcgaatttaatcccagagcgaacagacgcggagccccgggagactgcttcatgtcagagatgaattgtacgtaagtgaggacagggtttgtatcttgcagctgtaattcattaagatgaggtcacgcaggagcagggagaagcctaattcaatgactggcatccttataagaaggaaatctggacacagagacacagggcacgggcaagtcacaacacaagcagagactggagtgattcatccacaagtcaagtgacaccagggatgggcagct

SEQ ID NO: 8316 - DNA, 418 bp, Homo sapiens
  misc_feature (1)..(418): n = A, T, C or G
tgctgatctgactgtctttttagtggtcacactatccttaccttctgtgcttaccattctcttgtttactaatatgatatagtacatttctcatgtctctctaagaaagattgttaatgtatggctggttctgcttcatcttaaagtatttatactgtatgtggtcttctgctaatctactgatatctgtggtatgattattagaatcatatatatttgtgcttgtggttgaatgtagtattctatcatttggtcatagtctcataattgctacattgagctctgcatggacatttggatgctttcttattttatgctagtagtatgtgtgtgaggacagattagtgatcgagaatcactggaatgtggtggtgagatatatatatnttctccatatctaagtaagggattatatttc

SEQ ID NO: 8317 - DNA, 242 bp, Homo sapiens
accttctgtgtaagagtcagtgagagtagtagattgagatgtgagaaatagtagagaattagatataatggagaagttggggtggggtgctctttgaggactagctgctgttcgtgtgccttgtgatgccttcagggtgctgcttttgtctgctgtcgggtggatgtttagggtgaccagtggctggatcatgtgcggtgcatgtatacttgtatttgatcgcaggtagttatagaattatt

SEQ ID NO: 8318 - DNA, 258 bp, Homo sapiens
ggcgaatgcgagtgaacctcgactggtcttcgattctactaggttgtcactatgaccaataaccacccataagaacctcattgtttactatttggattgctgtgtatatacaagacagatatctccctttatggaaggagtaatatgatgaatcggtatgggatgggttgcggtgtcttggtcgtgatcaagctagttactattgaattgggggccgcgtgcatgtcgatcatatgggcagaaagtcctagcgtggtt

SEQ ID NO: 8319 - DNA, 546 bp, Homo sapiens
ggtactgaacagggaaagcatacctcaccacagcgattagcatagtgcttccatgcgtgatgtgacgccatctacttacaaggggtggcatttatatcagtaacaggatcactggtgtcatcatgagtagggtgatatacatcaatacccaggaccaagcatgatcatcctgctaatactgtcatgatgtgggtggggatgttccagacaggaaccagaggacaggagcgcagtaccatgacaagcaagatgaccagatccttcacagacataggggaaattataatgactctgcctttggactataggtataaataatggaatggtgaaggcttatggacatgtgtgtctaaggtgacatgtaagcgaatgatgagaggtgacttgaggcacgggctccaaagaatctcacgatgtaagctgtccggccataagtgcttgagacagaacagataggacgagtaaccaatcggaggggcgcaactcactatacaactattctatccactgtggaacgcatgattgtgtggatggtacagatacggc

SEQ ID NO: 8320 - DNA, 274 bp, Homo sapiens
gtactatctgtgaagttacacttttttttttttttaaaggtagagatgtgtgtgtgtgtaggtattaaagatgtgttgttggttactaaaatggattagtgggagatgagttatgaatgtagatgtattcagaagtagggtgacagattttttggtgacatggcgtggtggggtggaaatacagtggagtctgaaggttcggggagcgaagaatggcaatatcatcgcacatccgtgctccacacagcgctagtgacagatggagacctcatag

SEQ ID NO: 8321 - DNA, 290 bp, Homo sapiens
gccgaggtacatgcctgtatacggacatcctcttatttaagtgtttgtctctttcgtcattggggactccagcacccaaacatagttccctagtatactagttggtgccgaataaaaagtagctattattagaaaaggaaggtgaaattgacatgggagttagtaaaatgtataaggaaaatgatttttataggggaaaggtaaaggattttctggccggaaaaagcagcaaaggacaagtattacttaaagtcttgtgaaaataacacttcttcttgcttgtacctggc

SEQ ID NO: 8322 - DNA, 242 bp, Homo sapiens
gcccgggcagggtacaagcttttttttttgtttttttttttttttttttttgggttcaagataaaaacaaagtacaaaaggaaaatggggtgctgctactaatgcatcatacaaaccaatagcactgccgacaccgccaactcaagccattccaaccaaaggaagaaaggctggcgtttgcaccccctgagggaagggctggcttgtaaaacagcacaattcggagtggaatgggaagggta

SEQ ID NO: 8323 - DNA, 226 bp, Homo sapiens
ccgcgtcggggcagggtggcttaacgaaaactggaaatgtctgttgatggggaagaaacaagagctaatacaatagctaggagcaaataatatttctcttatatagcttgaaggtagcaggtacagtagctaggtacatagtgaaagaaggattacgatggtaatgaaataatttgtttgatacgctaatggctataggggatattgtgtaatatttgtaagtttg

SEQ ID NO: 8324 - DNA, 290 bp, Homo sapiens
acaagcttttttttttttttttttttttttttttttttttttttaaagcattaattaattaccacactttagaaagtatgttcgccggtaatatggaacgtagggggcaataaataataaaaggaggcgggaaaaaaaagacagatacggggaacatagggggccccgcggctccaggggcctcgaaaggtctatcgcgggaccccaccccccaagaagaaaaaaaccccaaaagccaggggaaacccccccgggggggggtaaaaaggggggaagggcccggggctccc

SEQ ID NO: 8325 - DNA, 226 bp, Homo sapiens
agtcttatttagcaccccagccatgtagacttctcatgctggcccttcttggcatctgctcttctcactgtcatacattgtgggaaggtgtaggggagtgtaagttctcagtataagtaagaaccctgtgtgagaccctccactacccagcgcactggccggtttaggaggaaatcaagtacactacaccaatcacggaaaggtctccttgcagagccagttaatt

SEQ ID NO: 8326 - DNA, 194 bp, Homo sapiens
cgggccaggtacccttatggaccctggcacaaaaatgattcagcttcagcgccttttgcctgcagttgcaggctttatgaagcaggttctccacctccagtaaattaaagtttttaaacaagtacccagggagaacggggaccctgcaccctggattactgggactggcacagtgggaggaaggggggaccgtg

SEQ ID NO: 8327 - DNA, 306 bp, Homo sapiens
ataagctagactccaatattccacacagctgactgatacgtggatgcaataacatgtgcatttcttaatactacaacttcatggacagagtagggtggtgagatgaatttgactgtgtctaaatcagtgtcctaaatggctggttctgtctgtgctcctttgacagagagcaagacagacggtaagtaggagattgactataatggggagatgatcgactgtgtgtgagagggggaaggggtagagagaggagggaatattggtctcagaggtctcaccatcttaatttggttgctcctaatgata

SEQ ID NO: 8328 - DNA, 530 bp, Homo sapiens
tacatgaagtctgtcttttgtcaaagttctatgcagtcccaggatagcgtgatagcagtggttaaacacaaccagctagttatagctttcattgtatggaaagacctctctggtctggaactctgcctttgaaattatccacgtagttcagaaggcaaatacttgttaaagggatcccaaaaggtaggagacaagtagtttttgttatgcattagggcagactttcaagcacaagacacaaaattgagcagcaaatgtttgggtagtcccatctcccttcggtttatatgtgggtagtaaaataaataaaaattttcttctttgtctctttcttgaaataaaatatcatgtatccaaagagagctgaggattctcaatttgctagattgctttaaaggggtcagatttataaaaataaagaattaatgaagaacaattttactggagttagtgtggtcaataggcccttttcattttgtgtcattgcttttatcacaaagatgttcaaatatcaaataaaatgttctctc

SEQ ID NO: 8329 - DNA, 162 bp, Homo sapiens
tttgtggaaggtgaattattgcaattttatcttacaacacaatagggaatagtgaattgatatataaatattatttatgaataaaatactaagactacgctagttagatgttgcaataaatcgaaaagggatatatggtgcataaaaagcaatgcgctatgc

SEQ ID NO: 8330 - DNA, 450 bp, Homo sapiens
gtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggtccctttgctgctaagtggttattaagggatcctccaccacccccccctgcaccaaaagaggaggaagaagaacctttgcctactaaaaagtggccaactgtggatgcttcctattatggtggtcgaggggttggaggaattaaaagaatggagggttcgtggggtgataaaggatctaatgaggaaggtgcgagggtagagaaaggcaaaaatggtgtggtgaagattcctgaagaaaa

SEQ ID NO: 8331 - DNA, 229 bp, Homo sapiens
ttattcagtgtatttttaggtggtattattatgtttattatttttctcattgatttagtgactatatcttcatcatgttttcatttttatttgttccgaagctcccggaaaatctaacttgctaacaattatttaaagggaggagagaggaaagcaggagcagctgcaggaacagcagcatttttgggtacctgcccggggcgggcgctcgacaatcactagtgaattc

SEQ ID NO: 8332 - DNA, 370 bp, Homo sapiens
ggtcttttggtgggagttgagcgcatcaatttggggtggtgtatgatccatgtttatacacattcatgcttccataatgcggttgctatagggatacgagtgactttcgtgagtgccaatttgacatcatgtctgggcacaagatctttatgtgttctaaattgagaggagatgatctatgacatccttcacttttatcgggtaatactacatgtatagttcagtaatgcgggagggtctctatagacattttgaatttcctagcataatgtctcaggaccgtggtgaagcattatatggtttttccaatacatggttgggacgcaaggcggcgtgtcacgtacggccacaggcagttcattgcccgggc

SEQ ID NO: 8333 - DNA, 530 bp, Homo sapiens
ttcatgatgggttactcttttatgtctgaattcatgtttatatatgcgtatagtcatctatcgtatatctataattatttataatatgtgttatctgcagtgataaattatgatcttgatgtcggtggtgatgattaattgtgtgactcgtcattactatgaagatgatcttgaggctggtatcgtctgtgcatgaaggtgattgagtgctggtgcacaggattttaaagatggctctaaagtgtgcatagaggttggtgttcagacaaaatatgaagatgagctaggtgatcggatgatggaaatacacttgtggagcgtgattctaagactgaagactcgcttgatgatatcctctaagatgaacgagtcgatgctgatctccgcgttctcaggggatcactgagcgatgaaagacaggatgaggtatgagtgtggtctcgacggccggtcggtgctggtggccgttgggatgtgacagcctggagatgatatgtgcataacgagatccagatgacaattccaggctg

SEQ ID NO: 8334 - DNA, 306 bp, Homo sapiens
gatgtggtggtggtctctattgagcatgtgcatgcactcgtgtagtactggaggacacagtagctctacagcgtcatgtggcagaggataatgatctggctagttgtgttttatagaagcagctatctaacagctctcgactcgcgaagacgctctgtcgggattggctgtaagcactacggatgtcacatggtgtagtggctggtctgcaatgagtggtgctgatggctccctgtggttacgagtctgtattcctattcaccgaagggtgtgctggagtgtctgtctgctgtctattaatacacc

SEQ ID NO: 8335 - DNA, 178 bp, Homo sapiens
atacaaaacgcgcaatatctaattatgaacagcgttaaatccctatcaaagttcaaatgaaatgtgtggcttatagtgtgaatgcacagatatatagccatatcatgtcatgttgtgtgcggagttggggtgggaacacgcagaaccggagccacgtcagctacacctcaaaaagtgc

SEQ ID NO: 8336 - DNA, 162 bp, Homo sapiens
agagggaagagggttaaagaaagatgataagaggatcaataaattaattttatgaaataaaattaggtcataggggtatggaggaaataaagaattagatgattatggtaataatgtgtaaaaatgtgattaagtgtaaagggaggtatgatgagaggatgg

SEQ ID NO: 8337 - DNA, 338 bp, Homo sapiens
tgataagatgtgaatacatatagtatcatactatataaataattcttggggtgtactatgtgcacaacattaataagtatatgggaacatgttcggcttatgctgcgttgcgatatattgtgatacagagggatctacgtctaggtatgctgatggaactagtacgagtgatgctcatatgaggtctgcctagcgtccataggcagctccacatgtacattcactgaaatgttgttgtgatatctgcactgaggaagcgcgtaggttatatgactttgtcatatttggtcgtgtataggcataatggaattcattcagtttagtgcaggaaagcacac

SEQ ID NO: 8338 - DNA, 610 bp, Homo sapiens
ctactttgtatcatctcttctattattttgaaagactgtttaatttttcatgtcttacattcccaactaaagacctaaaattgttttgtatccccactcaaaatgccttacagaaaatacaaaaatcaatttgatcgtttccttaattacaggagtcattgcaattagttacataatttgactcttggctatcagagttacattatttgaacttaaataaccatcttcctgtaactgaatataatttatattccctatctccagtaattaactggcataaaatacagaaataccaacaacaagtagtgtaccccactggtaaagtgcatagactctgtggttagacagactatataggattgctgaatcagatactacaatacatagcagtatgaccttaaaccattgtattaagtcatctaatcttctatatcctcattgtcaaaaaattcgtgtatcagctacgtacgaatactagtgtatgaccttccacaatcggcttaagctctctactaatcaatttactcatagtacaaaatggggaagaaaacagtatggtgttcggaacgcacacagtgactgatggagagtatgtgctagggagaaggga

SEQ ID NO: 8339 - DNA, 194 bp, Homo sapiens
  misc_feature (1)..(194): n = A, T, C or G
tgaaagctatataattagacattgtaaatgccttagataatttatgggnattttatctgaagaggtaatatgacatattggattactttgtgagtgtgaatataaagataagagaaggatgagagaaggatggtgatatgagggatgtggatgagaaagaggaagagtgtatgagagaaatgggattagagaaa

SEQ ID NO: 8340 - DNA, 210 bp, Homo sapiens
ctgacatcaccgactcatatgcttattaccaccctgcttgagcaggctggctcccaacggagatgaacgaccgtgttcctgcctggttgttattcgacatgctcaggactgcggggagaaaggatgagatccagcagggaagaactgcctgctgccagcacgcaggagagggtggggctgccggccattatgtccataccaacacaatgt

SEQ ID NO: 8341 - DNA, 338 bp, Homo sapiens
ggtactcatggatccataggaaagcatgtcagtgcctggtggccacactatacatggaattgtggagtatgaggaatatggcacgaccctacctcttcttaagacagttgcagttcacagggagaggaggaagatacatcaataaccccaaagtccatgaaggtgcaaagagttatgtggggctgcccaggcagaggtgacaaatgcccactggtgacaagacactggtggacatagagggaaaagcccacatagaaaggtttccaggcagacaggaagtcaaggcagttggggacgggaagtcaaacaagtgatgctgggacaccgctttgatgggt

SEQ ID NO: 8342 - DNA, 322 bp, Homo sapiens
ttcctgataaaggggactttccatgccgtcaacagggaagtatctgaacatactgccttataccgattgtactcactatataaggaaaatgggtgcagtagtgtggttcactgagtcgggtgggaacaatgatggtgcagataactgccaggagtaactcattctggtgataatagatgggacgtgtgcagcaacacaaaaataagccgatgaaagaaaagtcctcaatagagtgtgctgtagtgtactgggcaccagtaggcctggtgccccctggtacatgttaccttcggcacgcgtaccatcgcttattcagtaagtg

SEQ ID NO: 8343 - DNA, 178 bp, Homo sapiens
tgttccagaagttataagaatgatatactatcgatttttagaagatggatgaaaaagttgtatgctgagtcatacgaatgaatgaggtagacatgggaatgtaagtgtcaccatgttgtgatatgtgtgatcttagggtaaagatgaatgaaatatagtgagtatgctcccattcttt

SEQ ID NO: 8344 - DNA, 160 bp, Homo sapiens
acctagaattaaaaccaagactctgtgatcagaaatcctcaggcccggtcccttgttgcctgtagacaatgaaccaaaagatggcgagttcaacagtgggacacaggctgggcatgatggctcatggctgtatatcccagcactttaggaggccaaggta

SEQ ID NO: 8345 - DNA, 194 bp, Homo sapiens
gaatttagtaaggctttgggcataatgaattagaagcgggaagaggatttgtgcagataagttatgcttcggggctacttctcccatcaagtcaaatctcgtctgaattctggctatctctctagccatgttgcttccgcctctcaacaattcaactgggtggttgaatttagactccgggttctaatcttggt

SEQ ID NO: 8346 - DNA, 226 bp, Homo sapiens
caaaaattgggacgaagaatgatgaaaagtaaatttagaatgtgctgtgccgagaatgaaagaaaaagcagcgtggggtctgcgtatccagactgggggagtggagcaggaaatcacttagcccagagtggcgagaaccctaaaaataaaaataaaataaaataataagaaatggagcagaaggcgttcataggagccaattttattaactaaaccaaacccatga

SEQ ID NO: 8347 - DNA, 546 bp, Homo sapiens
ttcagagcagactaacgtgggctgccattatttctatttatatgtataagagtatgtcttcgtgatctgtataaaaagtgatcgtgtgaaagatgctgattgtcagtatgttatgtcaatgtaatcaaacataattgatctctttaatggtgtaggagatgggattgttctttgttaggtgatgatactgtcagtgacatacaaaatagatgaaagattaatcaatcagacgaaactacgcttatcactaatgaagaaaatgtgaactgggggttgaacataggcgtgagcatcgggtgccttggtggtcataatagaggtatgatgatcgtgtggaggggatagctgatctggtcatggacttctgtgggtaggtgtgaagatgtgttgtgtgctgacatcgaactcaatagaaatgaggatctgattgtgctattgatagagtgtgtgaggcgtgaggatttgctgattctctgcgctgaagagctgtgctgatgtgggctagttaacctgtggagacatgcaggctgcaatgaatgtgggcaa

SEQ ID NO: 8348 - DNA, 354 bp, Homo sapiens
tgagtacttgaaaaaatgaaagtgagagatgtaatactgctggagacaagtggtctacttttacttctaacttgtaatcaatgtgagcgatgatccattatcatccaaatagagtgtggagactatcggaggatacgtgagtgtcaagtattccaatagcaattaaaacaaatgacatgacttcgagacagctgactacttatttcggtaatgtgatttgaatgtgcctggcagtcgcaatatatgagatcgttcacgtgatggctgatgtgtcgccagcatattatatagggtagcgaaaatggagtgagatgctgttgggaggtcgatgagcatgtgattaatggttgtctg

SEQ ID NO: 8349 - DNA, 162 bp, Homo sapiens
ttttttttttttttttttttttttttttggtgttttgtgcttttattttacgaaaaagctaatggcaaaatctacatttaaactatagatgaatccaaagcctttagtgagagaaaggctggtggggtgggattacataaaatggaccagtgggcatatctt

SEQ ID NO: 8350 - DNA, 210 bp, Homo sapiens
  misc_feature (1)..(210): n = A, T, C or G
ttngtgaggtccggagggtacatgctgtagtgcccaaagttgttgtgctttttttattaagtatagccagggattacgtaggttcaaggtcccaccagataatgtccttaatagaaattatgttaaacatttatattcctctacaaaataccttattttcccaaataaagattaataattaggcaggtattaggagaattaaaaaaactc

SEQ ID NO: 8351 - DNA, 162 bp, Homo sapiens
gctatgacagaatcattgtatgtgagcttaaggtctctgcataaaactgaagttaagtagggtagcctgcccgccaccatgagctgacttgaagagctactccctgcgtgtaagtatctgttggcacagtatgtagtggggcgtacgattccagaaacgcac

SEQ ID NO: 8352 - DNA, 854 bp, Homo sapiens
  misc_feature (1)..(854): n = A, T, C or G
ctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacaganaggtgtggcatttggaaacgggaataaacaaaattgctgcaccaatgcactgagtgaangaagagagacagnagatcaaaggctttagacagcactccttcaatatgcaatcacagagaaagatgcgccttatccaagttaatatctctaaggtgagagccttcttagagtcagtttgttgcaaaattcacctactctgttcttttccatccatccccctgagtcagctgggtgaagggagttattttttcaagtggaattcaaaccaagctcaaaccagaactgaaaatagagattgcaggaatccttttctaaactgctttgccctttcctctcactgccttttatagccaatataaatgtc

SEQ ID NO: 8353 - DNA, 642 bp, Homo sapiens
ccgaggtacatcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcagttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtgggatttggaaacgggaattaacaaaattgctgcaccaatgcactgagtgaaggaagagagacggaggattaaggggtttagacaggactcctttcatatgccatcaaagagaaagatgcgccttatcccagttaat

SEQ ID NO: 8354 - DNA, 338 bp, Homo sapiens
  misc_feature (1)..(338): n = A, C, T or G
ggcaggtacactagaaagtcttttacaanaataatcatccttagatcaaccagaagaccaatcttcaatgtncgtcctngacagagatgggttacnntttaacatccctcctcctggttttcgtcccaatgttcctcctttaggtagtggcgtggtaagttggttgttggtggattgccaccccccctcggaggaatgcccttgcccataaggtgcctctgggttggcccactggtaaggtcctgcaattatcccctggtccaataatcccattagttccccaataggttaataccccaagttataaattcataatcccgccccataggcccacttat

SEQ ID NO: 8355 - DNA, 498 bp, Homo sapiens
aatcgattgaaccgggaggcggaggttgcagtgagccgagatgcactacactccagcctgggcaacagggccagactcatctcaaaaaaaaaaaaagaaagaaaagaaaagaaaagttaagtgcagagaatagtgcctgacacacggtatacagtaggtgcaatttcagtattagttgctactattgtcataatcatcagagtgtttcaagagctgtgcctccatggctctccacatcgcttcacaaactcccctgttctgggacccagcctgaattgtaaactccacccccgactgatgctaccctataagccaaacagaatcatggctggggtaggggctctaccctttgggatctggccgaaccaggaagaggtagagtggcctggaggccaaccacaggtgattcagaatgttcaccacgtggttcatcctgtcttactcctgctttacacgagaagccaccatgactagtcctcctcctgcggggacagacct

SEQ ID NO: 8356 - DNA, 242 bp, Homo sapiens
tgggtggatggatcagtggacaagttagtggatggatggatgatgaatggatgggtgagttggttggtggatggattggtggacaagtgagtggatggatggatgaataagttatttggggagacaaatggaagggcaggaagattgatgctccgcatgttcctggctttctgcactaactgtactcgacgtcactagaaaaaaaaaaaacaaaaacaaaaaaaaaaaaaaaaaaagtctgg

SEQ ID NO: 8357 - DNA, 756 bp, Homo sapiens
  misc_feature (1)..(756): n =A, C, T or G
tttctttcacctgtcttctaattagagcctcttactcatctgtagcacgagtcatttattttgtctagtacaaagaatatttcgaatactcatgactaaagagctcaggagttctagctaaagaagaatcttgaagcattggagttttgaaaatctgcataaagattttgaagattttttaaagattcatattataacagtataccgttggtctaatttttcttaatctactaaaaacgaaatagcacaggtcagatgtgacttgcttgctttctgctcctgtacaatccaggagtgttaatcaaaaagcaaaatttgtgacatcagttttatttccatggctactgattgtaatattacaaacatgagattactggctagttcatcatgaaggttaaagaagattcctccttggataggatctccaaaaccaacaccaaagggaatattatcagagctgcttccagcagcgtgtcctttcaaaaatgttctcattattctgagagctttgttttattttgtgagggttttatcatttgttgttggtggttaatattttaattttatgtgcttgtttgttttatttattcctccaccccaggtgaccgtgtangaaaatggttattttagatgtnagaagcccctctgttaggaagcagtttctgccttcgtttaattcttcttccacaaataagatttattttggaacttcagtcaaaaacatctgtactttgtacaggacaaagatttggcttc

SEQ ID NO: 8358 - DNA, 370 bp, Homo sapiens
  misc_feature (1)..(370): n = A, T, C or G
cctaagtcacagttctgtcggactgtgggtagaagactaggagatggtgagtggagtgtaaggaccacatgccganagaagattgatagaaaccatgggtaactgtcgaatctgtcagtcccggcatgagtgtaattgctttctctggagggcctggcgattctctcctacccagtggctatgctttatctatcgagcttgtgcccggtctgcatttctgattatgttgttgtgtattgtgtgtatgtatgtattcgtgggaagagtgtgttcatctgaagcctgtggctgaggattaaggttaggattgggtaaagatcagaatatcacgtccagatatcgcagcgactccctgtggatagcccttggg

SEQ ID NO: 8359 - DNA, 626 bp, Homo sapiens
acactggctgctcggcagtcacgccggtggccggcgggagagcggggagaagcctgggtccgtctggctcttaccacaccatgctcctgcttccacatggcagagggacagtcagcaggtgtgcagcgccccagctcctacttgtctcaacagtcctaactggccatggccaagagttctgtcagggcaatcaactccctgacacaggccagatggacatccgggagaaatccatagtactggagctggttcagagccccacggaattaagtcggaataaaaccacgagagaaagaacattttcatgggccctgcacggagcctcctgggcctgatggagaggggccccacccagaagagcacagggctggcccccacccctgcaccacacatgcgctttatcaactgaacactcccacagccacacggacaggattcattcaagtctgtgtatgtctgagcgcaggagaagaggatctactgagctctagctggagcttcatccagcgatgattactaatctcgtgctccaatgcagctcccatcctctcgaaggggatggtcggcgaccggacgtctacgtcttggggcccgttccccgagctggggtatctctgacggcttta

SEQ ID NO: 8360 - DNA, 210 bp, Homo sapiens
ggctgatcgtgctcgaggaggaaaggaaccgtaggttcacgacattgggtgtatgtgctcggctgaggagtgaatggggcgaagcagcatctgttgggatcatgagtgaacggctctaagtcagaatcgcgaacagagcggaaagatagggcagcggcgcggagggtcgggtggcctgggatagcgggtcggcgggcatgctccgggggg

SEQ ID NO: 8361 - DNA, 338 bp, Homo sapiens
gcaggtaccaaaataagaggagcgggtgcaggtaactgatatttactgaatagtaaagagggaagcgtgaaggggccttggagaatggttaacagcatctgtttccagctcatcacaggtgcacagcataagatgagagttggctatggatgggcaaatcactgaaggtagatcaaagatgggtgctcagcgccagtcggtctcatcgatgcctagctgttatgtaattactggatcaaaactagatgttattagtataagatatatgtcagataaagatagtatttaaaattgtgttgtaagataagagaacacatacaaaaatgtggattcttaca

SEQ ID NO: 8362 - DNA, 578 bp, Homo sapiens
ggtacatcagtctcagattcatcccagaaaaaagaagagcacaattattctctttttgtctccgacaactggggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatgggatttatgcagtaaagaagtctcggagaactgatgtagaagacctgactccaaatcctataataatcctccagatatgcaatgaacttcggaaattgaattaggtgattattgatctgacttc

SEQ ID NO: 8363 - DNA, 194 bp, Homo sapiens
gagggtatataactaggggcatgaagtgtgagctatcgttaatgagaatgacgtttggtttgctatcgctatggctaagaatgggattaagagaggaagtggcaaaaaaagaatggacgtattatgaggttttatgccggagcgactgaatatacaagaatgggggagaagaagctttttagatgtccttaata

SEQ ID NO: 8364 - DNA, 226 bp, Homo sapiens
cgagtactaaaatatctagttgtttgatagataacttaaactcattaatgatagatcgtaaagatctatagtcagtctcacaacagatgaggtattatttgtatgtaagtttcagcgtttgtgattggtttctcttttggaataatgagagaataaagtgtgtattcttgtgttttccctgataaatatgcataaggggatggggttaaacagtgttgaatatctc

SEQ ID NO: 8365 - DNA, 306 bp, Homo sapiens
tactgaaagatatagttaaaagatcaataacttaaatcagaattaatgttacgtaaagtcttatgtttcacatcaacacagatgaggtattataagtatataaaagacggtgtgtggggaaagctaggggtaagtatataaagtgagaattcgggtgttgtggagtgagtgttgtggtatatgtgcatttgggttggggtggtcaagtggtgcatagagtgaggaaaccatttctgcttggggtaatggcacatctccttgcgcataatggtattgaatatcatatattctatggagaaagaagtg

SEQ ID NO: 8366 - DNA, 290 bp, Homo sapiens
gaggtactgaaaagactcagtcagccccatcatgactctgatgaaaagagaggatatgttcagaactatggtcagtatcttccctgtctaagggattataagtatcttcccctggcagagctgagggggccataggtactgatctacagtgatcacagtcttggtgtgtagagagtgatgacagctagctcgactagggagggagtgccaaaaggtgaatatggtgagagaagcctgtgtgctgatggatgtttactcatctcctcggacgtggacgatattcactatct

SEQ ID NO: 8367 - DNA, 290 bp, Homo sapiens
aggtgcatattgaggctacttagaggaatgtaagacaaaatcctgtgaataataagcatcactcagaaccaacagcgaacagatgtagtgttgtagagtggataagtactacaaggctcacaatactacggattattattattaattggtcttcgtgaatagaaagtatacggggactacggagaaaagattgctactgagtcatgattagttataagaggatgagtaacaactacaatgtgttctgactcattgtgtgacccagcaccatcaccattcctatgcatctc

SEQ ID NO: 8368 - DNA, 466 bp, Homo sapiens
taccagcagagtcagtggggctagttgttatgtcctgtatcagtcactggtgatgggcctacctcataggagataaagattttctatgtagatgcaagtaaagtgagtcggtgtagaccagaataatcctcttctaaagaagggtctatggatgttctagggagtatgatctctctgatgaaagatcaatagttgtctagagtagatttttatttcttgggatgttgaggtgggaggatggttagatactataaggtagcggttgattgagtcgagattgtgtcaatgcatcagacttgtgtgatagagtgagacacttggtctgtttggaatctggatgatattggtcgtctctttctgatggtcgttgtttctccactgtatagatcatcatgatagcatttggctgagtaatatatgatagaagcgctgtgcgggagttggaggatagagatgaatcggggta

SEQ ID NO: 8369 - DNA, 194 bp, Homo sapiens
gggaggtaaaataagagggaggagggggtttagggaaattgattttagtggggtatatagaaaaaaaaaaatttggagggagaagattaaagaagttgagataaataaaatataaataagtgtattaaaaagaaaataaaaaaaaatggttaaaaaaaaaagtaaaatataaattttgaaaataggtgaatagt

SEQ ID NO: 8370 - DNA, 226 bp, Homo sapiens
gaggtggtggttgaggagaggttataagggaaaggataaagaaaatttattttatttataaaatggagtttttcaattttaatttggaagttagaaagggataaaaaaaaaaaaaatgatgggtataaataaaataaaagaaaaatttagggtaaaaaaggttggggattttgggatttgggtttgaggttttgaaaaaagggaattaaatatttttttataagat

SEQ ID NO: 8371 - DNA, 210 bp, Homo sapiens
atgaacaacttaaaaaaaatacaaaacctggatcaatggggcttctgggaaccgcgtatcttcccctcacccaaggcagtgggcatgaatctacttttaaaaaatgattaattttggccatctgagaagaaaagagcctaaaattgggtgatgcaacgagaaagtgaaagtcgagggaaaatgcagtttacaagtctctgaaatctaatg

SEQ ID NO: 8372 - DNA, 306 bp, Homo sapiens
gtacaaatcttatgtggtacataataaacattgtaaataactaacattctttacacatcttcattggcctgctcatctatgtttctaagccaataggtgatgttttaaaattatgtacagtaggtgatgtgatataataacatgaataacatagagcctcagaattagggagtagtgatggtgtgaaatcgattatgggcatctgtatcccatatctgtaactagatattttttactagtaattcaacatgttttgatcttgaagtatattactatagtgggaataaaggtaataaagaaaggatc

SEQ ID NO: 8373 - DNA, 386 bp, Homo sapiens
actttcaaatagctagttggatagtttgaattgtataacagtaatacctggataatacttactcgtatatgcgtgattaatacactctgaatcatatagatagtgattgtatgcatgatctgcgagtcattggttaagagctgaacgactatgtggacagtatgttaaacatggaaaagatggaacacaaaagagaaaaggatcccaatgagaaaaataagaatgattattagtattgcaatgtgaaacttaaagggaagaaggaaaagataaaaacggattggtattactgaatcagttgaatagaatcggataaaaaacaagcagggatagcggatcagacatgtagtaaaagcaactcgcccgatctggccgcaaaaagcacc

SEQ ID NO: 8374 - DNA, 530 bp, Homo sapiens
atttatttcattgctgaccattaggttgcagcatgcaactctcaacaatgagctgcccctctccactcctatagaagctccaaatactatggtaccactatgtaggttttcagcctttcaaaggcttttattattaacatcatcattacagaataaacattgtactaccctcagggaccaaggaagtacatagggttgttttccttttcttaaaatagccccagaattatgtttgctttttatagcttttttaatctctcttgtcacttcttgctattaatggtgctcctgcctctgggactctgccggccgcctccacccacgacttaaacaacatctcaccaattgcaaccggatcgtgggtgggacttccgctatcattttaggctttactaccaccatctcctcgcgggcagtgggggcaaccgcgaagacagaatttcacaaactttcagctccagcagtttcaaggaaatgttaaatgagaagatggaagaccgagtgtgaagagctaagaaaacaaaaagggg

SEQ ID NO: 8375 - DNA, 335 bp, Homo sapiens
tgaagggtgagctcctgggacctcagacagatccttccctctgatcctgccctgttgttggtatatctggggagtgtgtggcccagagaagccagtgatatatccaggtcacacagcaggcctgggtctagcatctgtctcctggcctccaggccattgtactctccacagcacaagtccgcctctcaggttcttttatttacaatgaaaccatttacttacacagttatcgctgcccactgggcattctttgggcagggagatggagttttgttaggtgggctctgcatacctatgggaactcagtgatgtaatgcaaagaaaaataaacttac

SEQ ID NO: 8376 - DNA, 482 bp, Homo sapiens
ggggggtggtggggagacgggggctttggaaaggaagcgccggggagaccactggtgttttagcgagaaggggggagcctaattcaaagccgggggggcggagccgataatagggtgtggggggggctttggggattttcggtgtgggggggggcttccattttttgggggggggggggggggtgagcggcgactcctcggaaagaaaagcgggcctggcggggggttggggggaggccaagtccggggggggggggctgctttttttcccggggaaaatgggtgggggcaaaaaagggggggggggggggggcttttgccgctggttaatttgtttcccttttcttttaattcgcccgggggagttttttttttttggagaggagggggagtaaaaggttatgcccgagcggcaacaaatattttgacagaattgcgccgccttgctcgtgaacaaagagaaaaagaagaagaaaaaagac

SEQ ID NO: 8377 - DNA, 322 bp, Homo sapiens
ggcccacccgcggtctctggccacctgttgccgtccatcacggggccacccttcttcatcctccgtcctgtacaatagctcagcaaagcggctggcggactggcccgggatctgctgctgctccagccatctacatgacaaccagagcctgggaggagctggatggcggcctgggcagttgctaagccctggaggactactctgtgctggccgagaccgaggaagacagggcttcagcgatactcaggctggccgacttcggcagcgcgccccacgactttgaggtggctgaaggctggcatgtggacaccaggaccaagaa

SEQ ID NO: 8378 - DNA, 162 bp, Homo sapiens
ttagtttggttgtatttttagattatggtataataatttgaaattataaatataaataagtagttagaaagggtttgaattaataatttggtgaacggttttaatcgataggtgttgattagatgaaagttagtagggtgatgtttattatggttgatagtt

SEQ ID NO: 8379 - DNA, 258 bp, Homo sapiens
aaggatgcaactcctgtcttggatagcactacgtcttgaccttgctcaaaacggtgctactaaatcaagtactacacacaaaaatgactggcaagaggagcatgtactgctggatttatagatgatttggaatggaatttttacgttctagaatccctaacccaccaggatgctcacatatatgtttgacatgccacaagaaagacacagacaatgaaacatcttcggtgtctagaataagaactggaacgtcgcgag

SEQ ID NO: 8380 - DNA, 162 bp, Homo sapiens
tattgatgagatctcccatatgatacttctcagtcatgtaccattttggatattcgctctttcactgtatatattgtgtcttgtgtttggagtgtaagtctcagatcagaggatctgttgagtctatagcataaccaaaatggagctgctaggatttattca

SEQ ID NO: 8381 - DNA, 210 bp, Homo sapiens
  misc_feature (1)..(210): n = A, T, C or G
gctactagttatcctactaagagaaaaggcaacatggacagcttcaaatttcgcaatgtaagactagccattaactggggcctggacgtgcgcggcttaactttggacataaccacatagcgataaattttacgaccccagtgaaaacaatgatttccatacccagctcttattccttcaccataaagattctgtgtnagcaatttaaaa

SEQ ID NO: 8382 - DNA, 562 bp, Homo sapiens
ccatagtccctgcagagatgaatccaggtggaagaatgcagaaaagctttagaaggcatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcacgaaattcaaaagaaaatgtgggacgagttagatctatggcattccaaactaaatgagctggattctgaagttcaggacatcgttgaacaggacccaggagaggctcaagaatggatggataaattgatgattcctttcaagcagtatcagcaagtatcacagagagcagagtgtagaacatcacagtagaataaggccacagataagatggaggaatatagtgaccttctgaagagcactgagggctggatagaaaatacacgtcatttgctggccaatcctgctgactatgaatctttgggggcactgagttaccatggtagcgatgtgcagatgggttaggaagaatcaccagcggaagcaa

SEQ ID NO: 8383 - DNA, 242 bp, Homo sapiens
actggcagctacgagcaaggccagcccgcgcagcacctagatagaaggcacgtggctgcatcccgacggttacagcctcgcgtctttcgggactcgctttctcctgttcgcgagtcgtgggctctgggcgctttatcccgaggaatactatgacagtggacatcaaaccgagcgctatagcaaggcagaacccgaggagggagaaagacgggagccggtccttgaaagcgccaggagacagc

SEQ ID NO: 8384 - DNA, 697 bp, Homo sapiens
tggctgcgcactcggcctgagaaactcggcaagcgcgcagtgtcgactccccggtctatgccaggcgcatctcaggaacgaggtctcactatattgcccagactggtctcgaactcctgggctcaaacagtccccctgcgttggcctcccaaagtgatggaattacaggtgtgaatcactgcatctgactatggcaaggatctctgtcactgaggtaagtttggcttagagattaaagctccttctatcttgtgatgccaccatcacaaggttctcaaggttgttgtgggagaagagaaggctaaaggagctcatagaatgcctttaatgctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactagggggataaataaaagttcggaggcagatgaggcaatgaatatgaattctgagaaaagtatggattggaaattcaatgaattaatttaatgaaattaaatgtgagaaaaaagaaagg

SEQ ID NO: 8385 - DNA, 386 bp, Homo sapiens
aggtgagttgggagtcagttcagaaagggcagagggtcccacaacaggaccagaacccagcgggggaacctggagagccccctgcgtgggccaacttactgttccatcgctcacccacctcgcgtccacagagagccctcccacactgcctggcctccctggccaccaaggcgctgccagaagacaaggtcaccagataatctgtcctcagagagggctgagaacccacccggggcagtatggaggaaccctaaagagggagaaagcaaaatgggtgagagtccaagggagggagggagagagagtggctgcagcgggagctcagaggagggaggaggctggctgggatgcacttgtcatgggagcaggtccagggcgggcaattc

SEQ ID NO: 8386 - DNA, 418 bp, Homo sapiens
gacaagcataagtacatactggaattaaaatactctaagaagaagaatcctaatgcatgccaaataagttctaaatatgctaaaccagccttcaataaagccatatgaccaactgataacaacaatctaaatactatacaaggtaactggcgcaagatttgatggagaaaagaccttcacatcaccacctcagtccttcacaggccaggtcctcctctctctgagacagtagggctgaacccggggacaccccagagccctgtaacacgcagccagcagtctgctgagctcgttgtgcagacgacaaagggaacacagaacttgggtctcaggggctgggcaggcagatccaagcatgagcaattagatcaaaatagaagccttgtttcaaagaaaaaaattgtattcttctaagtga

SEQ ID NO: 8387 - DNA, 370 bp, Homo sapiens
ctgatggcggtagcagcgcccagtcgagcacggggcagcggctgccgggcagggtctggtgcgcgaggggctggggcggaaggtcgagagggcgaggactgtggcaaggtggggctgctgctggagccctcatttgagatcgatgacagtgacaacttacggaagcggggatcaatgatctggacacagcaggatggtaccttgtccctgtcacagcggcagatcagcgaggaggagcggggccgactccgggatgtggcagccctgaatggcatgtacagggtccggatcgaaaggcgaaccggggcacctggatggactgcaagctggtggctatgtctcactcctaagtcaatgcgtgacccccgct

SEQ ID NO: 8388 - DNA, 226 bp, Homo sapiens
tactcgaatcgttgtgattgttggctgaatgtttcaggctatatatgtaagagatagtacatacatgtcttattcttaactccaagaatgcgtactttaggtgagggtattatgaatatgattaatccaccatgtaatcatgactattttagggtcattattggcgggtatggtgtatccatagtatcctctagcttctggcaaatgatggtgactgctgtatcta

SEQ ID NO: 8389 - DNA, 274 bp, Homo sapiens
aatgatgttggattatgttgcctgagatagcaacagagggataggtggggcggtaaggaaggtgtatgatcttttcgctatggcggttaccagtaatatccaggatcctattatcgagtcactcgtctacatatgtggctgagggcaatgctgtaatgtgaaattcgactgtatggtggtaagataccatatgcctgcggtaacccttcgatatactctggaatagtactgatttggttcgtttttcaaaggtagagcttgactcgacgaaccc

SEQ ID NO: 8390 - DNA, 162 bp, Homo sapiens
gtatcgtgattgtgaacagattatggtgcaagtgttattgaagaatccaagtgaagtaagggacaggcggtgtatcactcaaaccagtgggataacacaggtaccacactacatattccttccgtaggctggatacaccatgagtcttgtcatagaacagcc

SEQ ID NO: 8391 - DNA, 194 bp, Homo sapiens
  misc_feature (1)..(194): n = A, T, C or G
atgtctgtcgtctccatacatactggggtgtacagtagatgtgatgtcagactcangatggttatgtagtataagactgtttaaacctgctgccatttgattgacttcaacagaanagtagtactcccactatcggatagtttcagtgagtgataatagctggctcggatagatgtcatggattcatcccagtc

SEQ ID NO: 8392 - DNA, 162 bp, Homo sapiens
ataaaatgaatggataagagtgtggataaactaagaaggaaggagagggtaaagagatgaagaagattagtgatggggataggggattgaaattattagaaatgaaagaggaatagaaagaaaagtgaaggtattaagattgagttgataaagtaaaaggaa

SEQ ID NO: 8393 - DNA, 258 bp, Homo sapiens
agtgttagatttaaggtatcttatgaacagaagtaaattagattgataggaaagaaatagtaatggagtttgagtaaagaaaatgaatgatgtaataaaaaaagtaaaaattgttgaaaatgtgaaaggtgagagtgttataatggggaatgtagatatagaggtaatttaatattggattagagtattagatataaaaaatgaagtgaaatgaaaattatatattaataataggtgataatggtatgtatttgttat

SEQ ID NO: 8394 - DNA, 242 bp, Homo sapiens
ggtttggacacctgggggggcccaaacacagggacaaacattgtgtgcggctgtcgcttgaagaaaagcaaaatctaccgggagggctgcgcgcagggccctcaaaaagggggggcaaaacaactttattttaatagggggtattggccggggggtgggcttactcgaggtgatcttggccccgcccccacccgggatgggccttaaatccataaatggcctggcctttttattgcggtcct

SEQ ID NO: 8395 - DNA, 386 bp, Homo sapiens
tggaggaacctcaggaaactcgcccgaggtcacagagtgggtaatggagacagcaaacatgtgccgaccacttagtgcacaccaggttcctaagggctcttcagaaccctgaaataatcctgtggagcagatgtgatatagacccgtatttcaaatgaggggatttgggctgagggtggttacgggacttgcctgaggttaactgaggtaacaagcaccagagccaggattcgaaccaaggccatcggggtcacaggcacacactaccccccttcctctgctggctctgacaactcaaaccgggctgcagcatgggtgtgctctttccaccaagggacccctggggtggggctgtttggcctctattaccgctccttatttcttat

SEQ ID NO: 8396 - DNA, 290 bp, Homo sapiens
ggtttggcgcatggataatgagctggacctacatgatgaatagaagcagggatgatatgataaaagacgctgggcttttattgatctggggctcctttcccgggggagtccggtgagtccctttccaggtgggtttgcactcacacgagtgggcgggattatcatccacaagctggccaagcccctacctgtgggaggcttgatggcagggcaccatggctgaaatacacgcttgggggaacagatcaagaaagaaactacgcaccaaaagtgagcggggcatgcaccca

SEQ ID NO: 8397 - DNA, 162 bp, Homo sapiens
tgcatccctgaacacctgtctgggggcggggggtggtgggggagggagacctcagccgagggactctgacgagatttggtgatgtcctacgggcaggagtcattgtatgggggtgtgggaacagtgcctagaccacagggcacggcctactcagaaggtgga

SEQ ID NO: 8398 - DNA, 226 bp, Homo sapiens
gaagagccctctgctggccaaccctgttggaagaggacactggggatgggagtggcgaggtgcagggccgaccggagacaccggcagaagaagagatggagacagacacggaggccggagtgtctgcggaaaaggagggggatgacacaggtgccctgctggccgacttgatcgactgcgcccctgatgatgagaagccagcacctcccatgagacccgactccta

SEQ ID NO: 8399 - DNA, 162 bp, Homo sapiens
accaaacaaactacaaaaggactcatacgctactagccgtgagagtctctcttgctgtgttgacgatgacgagtggtggtttctgaacctgattgacattgatgaaaacggatgcatgtaccataatgcgtctacctgacatgtgggttgcgagcacataga

SEQ ID NO: 8400 - DNA, 354 bp, Homo sapiens
  misc_feature (1)..(354): n = A, C, T or G
ggaagcccgtaagtccaatatagcagatgtcagcagacccagctttgcctgcaagctgaaagaggagacccttccttgcttgtgtctagcttctggtgatcgtcagctgtcctcgggatcctgnggttcgcggcacgtcatgaccatcttggctgctggcaccgcggggcatcctcctgggtcttcacactgccttccctccgcgtgtctcaggctctaaattagccctctactaataaggatgccaatcactggattagggttcaccatattctagtacaaattcatcttatatatgattacatactgcaaagatcctatttacaaataaagattaattaataggtcccaagg

SEQ ID NO: 8401 - DNA, 226 bp, Homo sapiens
aaactaaaagataactcgcgagggaaaccaccaaaaccacaaccctaagggcactgatgcaacccctcaagaattgtagtgggaacacaggtcactgccaccaattctcgttgaaacatgactcttcatcttatggaattcatatatatattctgcaaggacgaggcagcgaaatgtgggaagtgacgacactgatggggaacactgggactgaggtcacggagca

SEQ ID NO: 8402 - DNA, 386 bp, Homo sapiens
gccgcccctggcgaactccattgtcggggggcctctaccagccgcccctggcgaactccattgtcggggggcctctaccagccgcccctggcgaactccattgtcggggggcctctaccagccgcccctggcgaactccattgtcggggggcctctaccagccgcccctggcgaactccattgtcggggggcctctaccagccgcccctggcgaactccattgtcgggggggctctacgagccgcccctggcgaactccattactgggggggcgttacgagccgccccgggtgaactccattgtcgggggggccgtataaaccgtcccggtgaacttcattggtggagggcctctataaccaacccctggcataattcaaggctta

SEQ ID NO: 8403 - DNA, 354 bp, Homo sapiens
ccagaaaggcccgcacctggggaagctggcgaacgctaaccgggaggtttttcttccagacttgattccgggatgttgagatcgttattcgaaatagactaacattcgaatcgcctgtgatggaaggagtttctgcacccgtagcctggcctcatttattctgcaaatgtttattgggtccttgccctttacaagatcctgtgctgtgagcaagaacaaggctttcatgtggaaataagccggcctttggttgaccaaaccgaaactcctctgaatggaaaatcaagaaaaatttggaaaaaataataaaatgttcaatgaaatggatataaatattttcttgtttaagtaggc

SEQ ID NO: 8404 - DNA, 402 bp, Homo sapiens
acagaacgagactccgtcttaaaaacaacagcaacaacaaaaagatcttgatgcctctgatggagctgaacatttattatacagcaacagcagcaaggattgctggtgggcagactacactgtagggcacctgctcttctgtaagaatctgaaagacactattgtcagagctctgcccttttggaatgaagaaataattccccacatccaggaagggaaacaggtgttgggtgagggctctggcagcagcttttctggcacagtcgagccttgggagggtctcccggcaagggccatcatggagctgagcctgcccactgggtttcccattgtctatgaattgtacaagaagaggctgaagcccattgaagctcatgcaggtcccaggagaagaaaaaggtg

SEQ ID NO: 8405 - DNA, 450 bp, Homo sapiens
  misc_feature (1)..(450): n = A, T, C or G
gtgtctngacaccctccanaancaccaggagnagaaacagctttccttggccttcccagccaaatctccctctgcctctctcccctggtgacgacaatggctggggtcttgacttgccaagatctggaaacggagaaaggactggatctccaaacttggactgccttggactgaccctggcctgggaagtgtgggctcangactccgagctcaagtcagtctgttcccccaacccccaacccactgcatccgggtgaggaagtgggcgcgagcgccacagcgcacataggggtgttaggagcgaaagactggagacccaaggactgtggggctggggtggtgggggcactgctaccgactaaacaagtcggggcgggctggaaaaacgaagggggattcggtgatgggggaagccaagggacaagggaaaaaggaaagggcgcattcttg

SEQ ID NO: 8406 - DNA, 450 bp, Homo sapiens
ttctcttctgtaccttccctgcacagcctcctccccagcctggatccacagccaccatcccatcacttgcctgctgcaagtatcctcagcactgcgcacctctctcccagctggcagaaaccagccctggggaatccaactcctggacttctctacacctgcacacaggttggcaggagttgccagaggtcttggcacagcagcctggctggaatcacagagcaatcctcaaccttggccaggccctcactgcccacctggcaaatcctcaagtgtgaccctagtcatctttctccttttggggtgtttcagactttctccacaagtctcagacaagctcaagtcactcccacatgaaaaataaaaacgggctgggtgtggggggtcatgcctataattccaacctaataaatggtaatggaagaattcctgggaaaaaaaatcttaaat

SEQ ID NO: 8407 - DNA, 530 bp, Homo sapiens
gacaggacgagactccgtcttaaaaacaacagcaacaacaaaaagatcttgatgcctctgatggagctgaacatttattatacagcaacagcagcaaggattgctggtgggcagactacactgtagggcacctgctcttctgtaagagtctgaaggacactattgtcagagctctgcccttttggaatgaagaaataattccccagatccaggaggggaaacaggtgttggttgaggctcctggcagcagcttttctggcacagtcgagccttgggaggctctcccggaaggggccatcatggagctgagcctgcccactggtattcccattgtctatgaattgaacaggaggagcttgaagcccattgagctcatgcagttcccaagagacgaaaaagctgtgcataaagccatggaagcgtggcttgcttagggcaggggcggagcgtgaaaggcggcagccggtccctatcctgacaacaccctcccaatctgccccattcctctatgcctctcacctcaacgtgtc

SEQ ID NO: 8408 - DNA, 194 bp, Homo sapiens
ctcttcttggctgcagccaagattctgggggctggggtggcgggtggaggtggggtaggagggataggaaaggcaccgggacaggcacgcgaaggagggagccgcggaacaaactgtcggtttcagcaggcccccacgaaaccgcaagatctgcaacaacgatacacagcaagccaaccgacgcaggcagagga

SEQ ID NO: 8409 - DNA, 562 bp, Homo sapiens
ctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaacagaatgcagctccagcttaaggaagcccaaacaagccacccagggagaacaaaacaccgccagcgtggattttccaaatttccctgggaaga

SEQ ID NO: 8410 - DNA, 530 bp, Homo sapiens
atttttaaacatccaaatatctgtaacatctgttataacacttgacatatgcaggtcaataaattaaactattgctttgggagaaatgtgcctgaattgttcactataagtctctgccgggagttattcattcaagtaaacaaaagatggcctatttctgaaaattaacaatgcgtagactggactgtaagtcgtgattccgtattttctcgagttactagctccatcattagcaacatgagaatgtgcaatgccaccatgttgaagtatgattaatcaacatcttttctgaaacaaagattttttttcccccattgcagaatttgatacaagaggtattctggttccttggggggctgaaaaaatctggtttacgctggttggaaccggggaattttctggggttaagctttttgctgggactaaaatcaaaactgcactgcagagcaggtgagggttcatgcgcgcgcgcccacaaacacacatatagagaattaaaaaaccatttgccatccatatgggaatattta

SEQ ID NO: 8411 - DNA, 472 bp, Homo sapiens
  misc_feature (1)..(472): n = A, C, T or G
gtggagtgtattgtagcatgagattaaggttttggcacatggggtggagtggggaccgaatgggatatctcagttttctgttgaagcctactatagacgttcctgtcatcgttcgactctctctcacgtgcgcactgccacgtgtgattagtatgtgaataccaccggtgtatgggattcaatggatatgcttgacgttagggaagagatacttatagtaatggggagtggacaggggatcttaatgatgcgagcctgccaggcgggaagcgggcagacttgcgggttcttcatgaatgcagagggtgttgggattggggggcttactgccgcgactgtctatgggaatcccatgagctggcctctactgatggaatatgctgtaaagaatgacggggtatggggatgggtanagtttgaaatttgaaaaaaaaaaaaaaaaaaaaaaaaaaaaaaaaaaaaaaaaaaagca

SEQ ID NO: 8412 - DNA, 854 bp, Homo sapiens
tcacctgtcttctaattagagcctcttactcatctgtagcacgagtcatttattttgtctagtacaaagaatatttcgaatactcatgactaaagagctcaggagttctagctaaagaagaatcttgaagcattggagttttgaaaatctgcataaagattttgaagattttttaaagattcatattataacagtataccgttggtctaatttttcttaatctactaaaaacgaaatagcacaggtcagatgtgacttgcttgctttctgctcctgtacaatccaggagtgttaatcaaaaagcaaaatttgtgacatcagttttatttccatggctactgattgtaatattacaaacatgagattactggctagttcatcatgaaggttaaagaagattcctccttggataggatctccaaaaccaacaccaaggggaatattatcagagctgcttccagcagcgtgtcctttcaaaaatgttctcattattctgagagctttgttttattttgtgagggtttttatcatttgttgttggtggttaatattttaattttatgtgcttgtttgttttatttattcctccacccccagtgacccgtgtagaaaatggttattttagatgttagaagcccctctgttaaagagccagttctgccttcgtttaattcttcttccacaaataagatttattttggaacttcagtcaaaaacatctgtactttgtaacagacaaacatctgccttcctaccagagctgctggccttgctgatgttagataaatgcattttgttctttgaagcccctcatagagaagagactgtaccataagagaagcccactcattttg

SEQ ID NO: 8413 - DNA, 594 bp, Homo sapiens
  misc_feature (1)..(594): n = A, T, C or G
tggctcctnagacttgttacctcaagtagagatgttgggtggacaaccccattcccatgccaggcattctctccactcatcaaaccacagtcttctgctctgttttctgtttgttttgttttgtttttttgagacgtagcctgggcaacagagtgagactctgtctcaataaaaacaaaacatacaactacttttgcgggatgctgtgttttactgttgtgttgttttggatctaacacgccctccagtttattcactcttagccagtttttccagccatatcttttccttgaatatgtccagacaatatttcatggatcaaaatattaacaaggataagatgaaaatgataaaaccttgtgcttttcattttcctacacagttttctgcatgtatcttgtataactacataaggtatgttagctaaaaaaaataaaagtgtgtgtttgcagggaagcggaggcgggggcgcgctggtgctgagtggagtcacagtaaggctgtagatggagcgccctgggaagggtggtttttttgggggtttgctcaccccggggaaggaggagtgagggtttgaggatgggtggaggggta

SEQ ID NO: 8414 - DNA, 162 bp, Homo sapiens
  misc_feature (1)..(162): n = A, C, T or G
ttgntggtgatctacattagaggggtaatattattattttttcattcttctgttatggaaatgtaaattattttactatgtttctttttatgagcattgtaaagattttatgaatgttattattcatgtatgtttatgtctatattgagatagtatgttggt

SEQ ID NO: 8415 - DNA, 466 bp, Homo sapiens
ggtaatatgttggatgagacttacatagaaggggtatattttgataaataccttctaccgaaatggaagagtaaatatatataacttgaaacattttatgagcattgaagacattaaatgaatgatattattcctacatgtttatcgctatcctgagatgagttgttatgggtatgttacagtagtaacacttctgaataaataattgcagcattctaccatttaggtttatagggaatagctatggagggacggacactcttgacatgaaacttataaaaggacagcgtgagagactaaaaactacaggcctttctctctcaagaacatagatagatgaactttaaacataatgcttgctaactttatcctagcgacagattaaaagcgcctttgggcctccatctttttttgttggtggggctattgttgcggttggtgtaggcagcaacccagtctccttctg

SEQ ID NO: 8416 - DNA, 226 bp, Homo sapiens
aataggcaggttatgtggcttattactggtgagcgaataatgtaaacgatgagcgaggccggggtgcaggctctgcagggctactggtgaggcacagagtacaaattgacatttcactatgtttgtgtgggcagacacttggaaggtgtctcaccgctgcacgagtgtgaaggctgtgcatagatcattctggcgtcctgtgttgagagcagcctaatgctcacgg

SEQ ID NO: 8417 - DNA, 274 bp, Homo sapiens
acatgggtgaaagaacatctatttagtgtggagcagataacagccatgttgtttgactaaacgtgaaggaaaactgcgtggaaaacagccctcaagaaaacccagtaacagcattgtggttattttcaggtccccttcctttcttttacaggatgctggagaaggcgatcctgtgttaagatgcctgcacaagatttggtggccttaaactgttttaagacttatgaaatgacaatgacagcctgttgctttggaattacgggattttaataag

SEQ ID NO: 8418 - DNA, 290 bp, Homo sapiens
ttttttttttttttttttttttttttttttttttttttttttttttttttttttttttttttttttttttttttttttttttttttttggggagggggtggttttttggggggtttagggggaaaagggggggggatttttttttaaggtttttttttgaaggggggggttattaaaaatttgaaaaggggggaaagagggtaaaaaaatggaaatttaaaatttttttaacaaatattggtggggccggggcgggggggggggggggggggccggaagtgacaggagtg

SEQ ID NO: 8419 - DNA, 162 bp, Homo sapiens
gggggaaattctgagcctgtcagtttggaattgaggtttgacttgtggaaggtggacttcttgtgtatttgctgctgctgcttcatgctggtttgtgtgggctacctggttgattatcttgcatgggtgggtgttgttggtggaatttgggatcacggggtg

SEQ ID NO: 8420 - DNA, 210 bp, Homo sapiens
attatggaaacatgaagctatttaggggtttttttcccataaaggaatggaaaagtaatccttttttattggaaaaagaccattattttaaaaatttattgtttttctgtgtataagaacatcagttacaaatgaaatgttatcaaattaatatcctatgcttactaagtccaccttctggtccttatttacaaaaaggggccattggcc

SEQ ID NO: 8421 - DNA, 242 bp, Homo sapiens
attatggaaacatgaagctatttaggggtttttttccccctaaagggaatggataagtaatcttttttatggaaaaagacaattatttataaaataaattgttttttgtgttatagtaacatccagtttaccaatgtaaatgtatatccaatataattatcctatgcccttatcacagctctactctctctggttcttcatacacaaatagtggctattggttatccttttgtcatctcaac

SEQ ID NO: 8422 - DNA, 194 bp, Homo sapiens
gccgggtcagggtacacctcacctaccccacctccagtcaatttcattttaagttcatacccaaactataagaatatgtaataaataaaattcagcaagttgtattttacctttaaaaatacacctatcttcccactttttgttaagttatttttaacatttttatgttatattatttcctatcagtggggaag

SEQ ID NO: 8423 - DNA, 210 bp, Homo sapiens
cgacctttataaaataacgactaaaaccttgttgtggaattatggtatatagctctaaagaaaaaattaatctgggattatatttagagttagtagagaagaataatagaaattttactttacataactataaaacatggtctattattaatataaggactaaaagctttcttggtggatcttcaacaatttaattctgcactttatata

SEQ ID NO: 8424 - DNA, 322 bp, Homo sapiens
gaggtactgtattatgggaaaacatgtaaggctatttagggggttcttttcccccctaaagggaatggaaaagttaatcctttttttatgggaaaaaagcacaatttatttaaaaaaaataaattggtttttgtgtgttataagaaacacccagcttaccaatgtaaatgtttattcaaataaataatctatgccttaggaaaggtctacctttctggttcttattaaaccaaaaagtgggcattgggtttccctttggtaacttaaccgccaggggttccatttgggaaatccacccaatcaagtatggtaggtctggcgt

SEQ ID NO: 8425 - DNA, 194 bp, Homo sapiens
tggaccggaggtaccagggtaggtagctagatgctgcttccttagcatcccacctgcagccttgacaagcttcaactatccagcagctcctatatcacaaaccgcacctacacgctggctaaggaagttagcttggctgataacaacacagacgaacgaatcaacggggagaaaccgatccatggagctaggtc

SEQ ID NO: 8426 - DNA, 402 bp, Homo sapiens
gtacaagctttttttttttttttttttttttttttttttctttttttttttttttttttttttttttttttttttttttttttttttttttttttaaaaaaaaacaaaaaacaaaggaaattaatggggggaaggggaaaaacggggaaaaaggggggaaaaaagggggaaaaaaaaggaaaaaaaaaaaaaacaaaaaatcgcgggggggaccaaagggggagggggggggaaaaaaaaaaaacggaaaaaaaaccaaaaccaaaaaaaccgggaaaaaaaaaaaaaaagcctccctctttcaaaaaaaaggggggggacggggcggggggaaaaaaaaacaaaaaaataaggggggcccgggaaatatcaaagggaaaaatcccacaacaaaacaaaccc

SEQ ID NO: 8427 - DNA, 450 bp, Homo sapiens
agctttttttttttttttttttttttttttttgtctttttttttttttttttttttttttttttttttttttttttttttaaatcaattaaagaattatgaaatttatttgggtacagggaataaccggggcaaaatggtgggaaaagttggtaaaacaagtttacattaaatttacttacaattacggtggggtacatttttggaaggggtgggtttttaaaaaaactggcttaaaatcccaaccttaaatattttggaaattaaatcattagcttttctttttttttattaaggaggggggcttgttcttgggtttatttaacttttacattaatggggcacttggttatcttatgggataattctttttctcatttaagcctccccacaaccttggaaagggattaccccatttttatggggggagaaacaggcttagaaggggaaa

SEQ ID NO: 8428 - DNA, 194 bp, Homo sapiens
ggcagaacgatctgcactctttgtttaggcatgttggcttgacaattaataactttcatctgacttttataaggaaacggacatgcttggaggctgaggatgcttaatggaatgataacaacacagacgtgggtatatttgatgtgacagtgattgacatattcagtctgtacgagatctgatgattgaatgag

SEQ ID NO: 8429 - DNA, 354 bp, Homo sapiens
  misc_feature (1)..(354): n = A, T, C or G
tctgactatggaaacatgaagatatttacgggtgtatgccactaagaggagaggaaagaaatattttttataggaacaataccataatcaaaaaaaaaaattgtttattgtgtataaaacacaagccacaacgaaatgacatgaaaaaatatttatgattangaaagggaatgttttgggtttataaacaaaagtggcattggtttactttgtaagtaacgaaggggttcatttggaatgcagcgataatgatggagtatggtttaccatatttttttaggtaaaaaaaaaatgctctggggcatataatggttatttttaacggggaaaggggggtagttattaattttttta

SEQ ID NO: 8430 - DNA, 226 bp, Homo sapiens
ttacatatgttgttagcataagacactggcgatgtaactgctctaaacaaaacaccgaaagttgtcctatgcaatatatattattatatacatatatatatttacataaaatactaaaaaagtgaaagccaataataacattggataaaagtaatacatatctgctaagtgacaatatcaaaaaaatcaaggaataattttacaataatataaataaaaagaatgt

SEQ ID NO: 8431 - DNA, 498 bp, Homo sapiens
ccccccccttttttttttttttttttttttttttttaaaaaaaaaaaaaaatcatgagaaatatttggggacagagaaaaacagggacaaaaagtggagaaaagaggtgaaaaaaaatttacataaaatatacaaaaaaatacgtgtggggacatatttgtaagggagggggttttaaaaaaaacgggtaaaaaaacaaaacttaaatattttgcaaaaaaaaaaattttctttttttttttttaaaaaaggggggggagtattttttgggttaaaataaatataaaataaaagtggaacttgagtattttatggaaaaattttctatttcttttatacctcacaccacccttgggaagggttatacccattttttgggggaaaaaacaggggtaaaagagggaagggggatattttgtgcgcgcaaacgctttatggggggaagatttggtaattgaacctataattggggcttctttttaaatataaaatattttg

SEQ ID NO: 8432 - DNA, 178 bp, Homo sapiens
gctcactgtagctacagcatagcagaccagtagagccagagaccctccattcaacacataatgggaaccttcctccttataaaggcggcaggcgccaccttcaagaagcgaaaaacctaacgcgacgcaaaagttatcacactaaacaggacaacctcccgactccactttgcccact

SEQ ID NO: 8433 - DNA, 306 bp, Homo sapiens
actgattgtggcaagcatgagctatattaggggacttgtcaaatagaggagtggaatgtggtaaaaatgatggaaaaagacaagtgcataaaaaggaaaatggcgtgtgtgtgtagaacaccagatacaatgaaacgtcatgcataaatatctatgcttagaaagcatacctcatggtcatatgaacaaaagaggcattggtgtaactttgagaagaacgcgggggctgatctggaacacgagaatcatgagggggacaggaaacccatcttgactatggggaatgaacatagctgagacggagcc

SEQ ID NO: 8434 - DNA, 194 bp, Homo sapiens
cggagtatggagaaatgaagctatgtatgtgattgatcccctaaaagaatggaaagttatctttagtatggaacaacacaattatatgagaaagaaaattgtagtctgtgtcttcaataccattatagatgtagagatgcgtatcaatagaatattgtatgcgttagaagagaaatacctacattggaccttat

SEQ ID NO: 8435 - DNA, 514 bp, Homo sapiens
gcacgattgtacatgcgtggcgccaatcaacaatatataacacgaccgaaaattattgttgcatgatgcatgtttgtgtggttgctcacactgcaaaggactgtataataggggatgaaacggtgctgcggtgacatgatgatggatcgtggtgatatgcatgattgacgagctgacactaaccatagaagatgtggtgatggattaatatgataagtcacagacaaagatgcaggacgtggtgcccgacaatgccagctatgacagcgcgctcatgacgtgtcatatcaagggtgatgacagtgatagccagagggatgctggatagcagatggaggcagggacaattggtgaataggagtggagagagcatagcagtaggagaactggagaagctgcggtgtgtctctgagtgcagctggaacttggacaagagattaggcgtgaggtgaacatcataccacctgcccccgccagacgtgacaatgataagccacaatgcgtatgctctcca

SEQ ID NO: 8436 - DNA, 322 bp, Homo sapiens
acaagcttttttttttttttttttttttttttttttggttttaaagtttaataatgaaaacacatggaataaagggggtaatccatgtattggaaacagcagaaaaaggaggaaaggggaccatccccataggggacactaatctttggggtaaactaaaataaataagggaaataacacttaatacaataataaagaaaaaaaaaaaaattacattaaaaaaaaaaacaggaacgggggaaaggagcccgggattgggaggaaaggcggtgcatggaaaagaactcaggttcaggggaccttcctggaaacattctggtgt

SEQ ID NO: 8437 - DNA, 354 bp, Homo sapiens
caagcttttttttttttttttttttttttttttgggtttaataataaaaacacttggaattaacggggtaatccaggtattggcaacagcaaaaaaaaaaggaaaggggaccatcccaaaaggggacacttatccttgggctaaattaatataaataagggaaataacacctaataaaataatacagcaaataaaaaaaattacattaaaaaaaaaaacaggaacggcggaaaggagtccggagtatgggggaaaggcgggtaagggaaaagcatccaggctcaggggaccttccctgaaaacttccgggttctgagcagctcaactcagtcccaggcataacacgtaccccgg

SEQ ID NO: 8438 - DNA, 258 bp, Homo sapiens
acctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacctgcccgggcgggggggggaggggggggggagaaggggggggggggc

SEQ ID NO: 8439 - DNA, 290 bp, Homo sapiens
  misc_feature (1)..(290): n = A, T, C or G
tgtggtcaggcttatgaatatgctcangtttaatgagatgctctgttgtaatgtgataggctgtggaaacaacaatgagtggaatgacatcaatgatgccaatgaaattgagcatgtcaactagcgcatgaaaaatgggcatgatcatcaaagatggtgtgacggtccataagcgtgcgacgggccatacaaggactttgtgccggaagaacggcttggacatggggataggtaagcagatgggcatatgtgaggggaacggtatcttggctgctgacatcgcgatcgct

SEQ ID NO: 8440 - DNA, 434 bp, Homo sapiens
  misc_feature (1)..(434): n = A, C, T or G
ggtcggccngggtcaagcctgcgtatcagaatctgagacagcgtgttggcaactttgttgcaaatcacttggcaactcacacatggagtccgcatctcaataagaaccagctaagaaacaacattaaacaacaagtcctcaaatcaggaatgttggagtctggtattgaccgaattatttctcaggttgtggacccaaagatcaaccacacattcagacctcaagtagagaaagctgtgcatgagtttttggccacgctaaatcacaaagaagaaagaagtggcaacacagctcccgatgatgagaaaacagacacttcccttattacacaaggtgttcctactcctgggcccagtgctaatgtaaccaatgatgccatgtcgatattggaaaccataacttctcttaaccaagaaaacaaggctgctaaggct

SEQ ID NO: 8441 - DNA, 450 bp, Homo sapiens
gacgggctccacaaacaatcacggtgtggcacactcaaactcacctacgcagaacctaaagcggtgtgtgaatttgaacgcggacatatgtcatattagaatgaaatataggcattctgaaaaattgtatttctatgtgtagagatgaaggaaggatgggtataggcttagcttgatactgcaaatataaaccagggatggggtgtaggaattgtaaaaacaggtatgatctgattattgtaattcataacattaggagagagataacggactaatattgcttcaacagataaaccaaagaaagaaggagtgccataacatatactctgcacacaatgggacctacagcttattaaactgattttctttgtgctatatctgctaaatatttgttgataaatgtccacttgttggtctcccatactgtacgaatgaaacctcaatttacag

SEQ ID NO: 8442 - DNA, 210 bp, Homo sapiens
ggacgtgtacttgagaaaagaagagtaataatgaatataacttaatcaataaaaaaaacaaggtatttaaaaaaagaaaggaattaagagaaaatctgaatagatgtatgcaagtgtaagcttaataatgattagagtattatttggataactaaataataatgaatgaagcagagactgaataataaaataattaggagtagactaagg

SEQ ID NO: 8443 - DNA, 434 bp, Homo sapiens
  misc_feature (1)..(434): n = A, C, T or G
gtaccggcctgaagataaaatgaatgaaataatgaataggcatatcaaatgatatatagtaatatacgtgggagcaactagcaatgctgataaccttgaatgatgacaaaacaaaattggtaaaatagaagaataaattaccaatacaatatactagacattgttaaaccacaatggtatagtgaatgcaagaattatgagtgaaacacacagtgaatagagaagcgagatacgacatatgaaaagacagtgtaattctgatggtnggtaatggtgggtgggataagactctatgatcacatagctgacaaggcgataataaatgatcaaaaaacatatggttggagaccatgcgctggggactttttctgtaggatatgggagtggacaatctaggtcgccaccgcgctaatcactaatgtattcgcggccgc

SEQ ID NO: 8444 - DNA, 162 bp, Homo sapiens
acgtgtacttgaaaaaagaagattataaataagtataacttaattattaaaaaatacaagggattaaatgaaagagagtagaaaggaaaaattggaatagatgtagacaagattgatgttaataattgattagagtattatttgtatagaaaattataatga

SEQ ID NO: 8445 - DNA, 226 bp, Homo sapiens
gacgtgcacacctgaataaattgtatgctatactaacttgccaagattaccacaacattaaaaacatatgtatacattaatgttctggcagtggactatgagaaaaaaactgaaatgaatacagtgatgcatgtagaacatgtcatgtgcaaactggagtggatgttgaggacggagcaatgagaatctgaaaactcacagggatgaaaaaaataaacgatactta

SEQ ID NO: 8446 - DNA, 242 bp, Homo sapiens
gagtgcacaacaaaaaagaagtgtataaaaaaatattgcatgatttattaaaaataaaaaatattagaaaaaaaaaagaattaaataagaatttgataaaataaatacaagaatacttagacatatgataaaaatatgattgttctactacattctaattaagaaaggagattgagagataaataaagaattaagagtagtgaaagagtaatgagtaagagtatgaaatagggatgtaatga

SEQ ID NO: 8447 - DNA, 162 bp, Homo sapiens
  misc_feature (1)..(162): n = A, C, T or G
aagtaccaatgtgctgggaggacccaataattgatgcaggggtgtggggtgttacactgtgactaaaaaaaccacataacatcataactggaacatcactatgttgggatctgtatctacagatcacataaggaagggaagtcgtggaganaagcatggggt

SEQ ID NO: 8448 - DNA, 194 bp, Homo sapiens
caggttaaaaaaaaaaaaaaaaaaaaaaaaaaaaaaaaaaaaaaagcttgtacaagcttttttttttttttttttttttttcccagtattcataaaataaattttttagattggcctataaaaaaaaacatccaaccacctttccctaggaaccttttgaacaccataagaacaaaagctctaacatataccta

SEQ ID NO: 8449 - DNA, 513 bp, Homo sapiens
  misc_feature (1)..(513): n = A, C, T or G
gggtaccaaatacaccgacaaaagaaaaaaagcagatgggctgctaggtttctgcttttaaaaaatttcatataagaattgggtttcaagcaggaagccagaacttctgcctctggttcttaaattaacattcggtgtgtaatggacaataggcagggactcataatttgactaactcacatgctcaagcatgatcgtgtccaatttctacaggcctcctttgtaaagaaatgtgtaacaatggggggaaagtcataattctacctgaaaacatggattgtaagaagaaataaaaaaatcaaacagtatgttttaagtttcccttttgatactgtgtttcagggtaagtgacagcttctgcaaaccaagactcagtcctgattataaaggatttttaaaattacattattaaaaatatgtatttattcttctttcactttatctattttccaaagcctctttcaagtaaactgtgaagtgcctgagtacctgcccgggcgggngtggtgggtg

SEQ ID NO: 8450 - DNA, 638 bp, Homo sapiens
  misc_feature (1)..(638): n = A, C, T or G
actagaaaagcctggctgccatccatcgctgcctctgaggtggaggaagaggcgggtgatgtgctcacttctgatcaacatgtgttgcctcctctcagccaacttctatctcactgcactcactctggtcatgataaatgttcgtcacctttctgcttcattccttanggcctaaatcangaagctgttttatcgatggtttccttttgggtcagtaaccagctttggataatttcctctgattattcaagtcgtgggacaggtaaactacattcagcangaacttttctncgagagtgttatgtcatggaaaagacaccaaacacagcaagtattgtaatgaatacaccatcccaggggtcagtaagctctgcctgccaagaagacacagtgaggagggtccacagtcctgatgangtggcgtttggtaacttgtagaccctagcatggccaggtctggtcacccttaagaacttctcagagaaactaggaatcttcagtgaaagaactaatgttctcctcagctgaaattcccttgcttgtcagcatttctgcaaagctcacacttgtttcaccatacctcccttggatgtgacatgtangtangaagtatgtgcangtgggagtcatttgttagg

SEQ ID NO: 8451 - DNA, 162 bp, Homo sapiens
tacatgtcacaccaccgccatgttttgttgattgaatcggcttgggtatgcggcctccgctgactgcattggacattgatctcggggagacgtgaagaggatgtaagggtggctatgatcgctaatagcaccgagtgcctccttctgtgaggtgactgagac

SEQ ID NO: 8452 - DNA, 386 bp, Homo sapiens
gtgcatgctatcaatgtgtccaattcccacatcctgagctacgcactggaagacatgcctaagaaaatagacgaaatacaggtacttcttgatgacagacgaagcataagataacatatcatagtatagatgaagcaaatataacgactaaactaatcttacataacaatgcattacattatttgacacacatggtcatgatgtgattaagataagatagacaaatatgaagattaaatgacataatgggtgtgaaagaacgaagtgaattgatacacacactatggtaatatctgtatgatatacactaatactactgatcatacaactaaaacaaaaaacaaagaatatctagttcctgcttgtcaagcatgtgataactaatg

SEQ ID NO: 8453 - DNA, 162 bp, Homo sapiens
tgcgtcatgcttctcagtttcttctggtaactaatgaccaagatgaccaatacattgtcaacaatgccatgatataagataaggtagtagaatggattatttgatatttattttgtaaatgtgcatctttttcaactcaattttatatttctttatgatttt

SEQ ID NO: 8454 - DNA, 194 bp, Homo sapiens
ttacaacttataagaaaaagtaaagggaaacctcaacatgcatgcaactgccttgtgtgaccagtgtaagtaccccccacgagctatggaggataatttagccccggaagcgttatgcttttcattattcaactgttctccccagggtgttgcttggtcaaaattaaattatttccatccatagccaagatttg

SEQ ID NO: 8455 - DNA, 178 bp, Homo sapiens
tttgatttggttaagacttgatgatatggatggaacctcactcttaaatgcgtgatagacacacactctatgcaaactgggaagtttgacagaaagtctgggtagggaaacacacatacaggccttggtcatctggctagcagaactatcctgtgttgagacaaattgcccgtgcgct

SEQ ID NO: 8456 - DNA, 226 bp, Homo sapiens
gccgatgtacgaaggaagccaatactacatgaggtgtaataatgcatacctataactgcactcacctctatgtaattgctcacatgccgaccaaggtgacaattttcttcactgctgacacttctgagtgatgatatcaacgaatgaacacgctgccactctctgacaagacaactacgaatatcattatatataagaatagggaggggctctgcttactaaagac

SEQ ID NO: 8457 - DNA, 482 bp, Homo sapiens
gaggactgtgtaacatgtgtcactgggcaagctgtgcctataatactggtgatgctgtgagagtatgtgtttggtggacttgcagtggttgtgatttgtaagagttacttttattttttgtaacattttcttatgatcatgtctgtgttgggttgatagtgaaggatataatgacttgttggttgtattgtagatattgtgacatcagacgggatcacgctaatcacttttgtattttcgggcgggtgtaagtctagcatatgggagagctacataagcgttggattcatacgttgaactattctataatgtctgctattataggttggcgtgatgatggtcataagtggatactgtgtgaaattgttattggctcactattgtatactatataggaaccggaataattggtgtaaagattggggtgcctgatgagtgagttaaattgcattaattgcgttgtgctcactggctgctttcca

SEQ ID NO: 8458 - DNA, 226 bp, Homo sapiens
taggcatttctgacattttataaacctacatttaaggggaatttttaaaggaaatgttttttcttttttttgttttttgagggggcaaggagggaccagaaagttagctcttcttatgtggaatattatcataaaattaccttagtaaatgccatgtttataatctaatctttcaaagtattgaattgatgtctgcaatgcccatcctttcttcttaggaattgga

SEQ ID NO: 8459 - DNA, 162 bp, Homo sapiens
aggtgtcacatgtagagctagtcatattaatatacctgaatgttatgtattcatgctaattaatataatttgcaccaacaaaaacgtcaaacaacatatgtgtttgggaggtctttatgtaactctgtatataaaatacaatgcacgtttttcccgttgttt

SEQ ID NO: 8460 - DNA, 674 bp, Homo sapiens
  misc_feature (1)..(674): n = A, C, T or G
ccatgaagtctgtcttttgtcaaagttctatgcagtcccaggatagcgtgatagcagtggttaaacacaaccagctagttatagctttcattgtatggaaagacctctctggtctggaactctgcctttgaaattatccacgtagttcagaaggcaaatacttgttaaagggatcccaaaaggtaggagacaagtagtttttgttatgcattagggcagactttcaagcacaagacacaaaattgagcagcaaatgtttgggtagtcccatctcccttcggtttatatgtgggtagtaaaataaataaaattttccttctttgtctctttcttgaaataaaatatcaggtatccaaggagagctgaggattctcaatttgctagattgctttaaaggggtcagatttagaaaattaaggaataaatgaagaacaattttactggagtaggtgtggtcaatangccctttttcattttgtgccattgcttttagcacaaggatgtcaaaaatatcacatagaatgtcatctctgatggactgacagagacctcctgttgtgctgtgttaggacatgaggcttatcccagcttggcgggagagaatgctaagcatgatgagtgagatctgccacaggcacggatattttctgctcctcttctgtttgtttcaaaca

SEQ ID NO: 8461 - DNA, 338 bp, Homo sapiens
atcaccatcagggtaaatgacactcctgatgatgctgttaatagaaactgggttataacacctccccattacactcaagcacaatgtgtgtagttctctaataaggagatgaattgttcttttataccatgagagtgacatgcacggcacacacttggttaaggggtgtgcctgcatcaaaaataaaatacatagaatcagtgtaatgtgaacataaaataaagaataaatagcgtggctgtcacatgctatttccctttatggaaggtgagtgatatgtcgtgcatgctgcgttctgcacaactggcctactgggagggcactgttgctgcctggtt

SEQ ID NO: 8462 - DNA, 498 bp, Homo sapiens
gaagagcataccgatctaatagtagccagtcagggttgtccgagattgcaaatactagatctatatatcatatatctatcattatatatatgggagaatatattatgggaaatatatatcaaaaatctatatataataaagtatttagtagtaatgaatatggtgatatgaaaatatatatataatatattatgtatatatcatgatgactgatatactgagactgtcgtactctgacttatgatgcatggctatgtgagcacagggatgtgactacggggctatatatgcagggaaaataaggcagataacatgggtagtatgtctagggtagtgtgtgaatcacagaagatgaatcagtgaagagatattattgaattgatgctattcagataatgtgggtgtgaacagatgcatggcatcagaggcatgtctgatatggcatgaatgagtgaagtgaaacgtatgaagagatactgattaaagagaattcatgca

SEQ ID NO: 8463 - DNA, 290 bp, Homo sapiens
ggtaaagctatttggttcgattgttaatttagtttgctttagagagtagaacatataatgcgacaaaagattagtaatgagaaaatcagtatttcattggatgtgttaagtgtcaaaagtcactgtaatggtgttgtgttcaaccggttgtttgttttgaagaataatggtgtatgtgttacatcccattcttcatgtccaaattttggacgttccttgtctcactcagctgtgataaactggtctggagttgctgaccgaccattgttcatcgaatgaggcattatctg

SEQ ID NO: 8464 - DNA, 242 bp, Homo sapiens
ttgggtggtggaggaggtgtgggtggatggtggtgaagtgttgtgtggatatgtatggtttatagagtagatgagaatgggataaagattgtgaattatgaggatgtggagtagagtgagtataaggggtaagatgtatgaaatatataatgaatggattatgtgaggtgaaaatgatagatagggtatggtgtgaatggagaggatgtaatttataaaatgaatatggtgttttgattgta

SEQ ID NO: 8465 - DNA, 178 bp, Homo sapiens
gggccgaggtgcacatgtggaaagtaggtcatgagataaaaccatcaatatctaatatatatgaatcaagtgtgagttcacaactacaaacactaaaacacattattaaaaaagcttgtacgagcttttgctttttttttttttttgtttttcggatcacaacgcttactatacgttg

SEQ ID NO: 8466 - DNA, 402 bp, Homo sapiens
cgcgggggaggtacacttaaacactgtgagaataacagagaaagatgagggtttttatatacagtggccgctgtgtttgcggcacttgggaatgacatgtttgtttttacaccaccgtgagcgggacctggaagtagagggtgcgctgcacaaggcccaaagagaatatcattacttgctgatggtgggtcacgtgcgccgggcacacggctgtggcggagctagcgctggccgcttgccagcttcacgcatgggctccctactcctgacgcctatatgcatactgttgtgtgttgcaactgtgtctaccatacaatgctcggagggatgctgggaatgacgtggtgtggggagacatggctatgacggttgaagattgacccatctttccagggtggagcg

SEQ ID NO: 8467 - DNA, 210 bp, Homo sapiens
ttaccgatgcggccgcgccgggcgatgcacgtgatcaatcttgtactgaggccacagggttgcaccagaaattctgcttctaacacttatgtctgagtcctgtcctggagagggctgactgcacaatgattatcttttcttttacatgtggcacgtacgtgcagcatcagcaaggtggaggggggctcgcgctccacacgcccccaacaa

SEQ ID NO: 8468 - DNA, 674 bp, Homo sapiens
cggggccgacgtgcatgataaaaatttgtggaaaacatgggtcctgtatacgggggcggatcaactcctgacacgtaattcttaggatcaatatgttgggctgtgctgaggctgacaggtgatcttggggtggtccttttatggctcgtggagggtcttcatggttaggcttgcattataccatcagatcatagaagcggacacattgactcatatcctatggctagtaaataagatgtactggatagtgaatctctttggttacgcatgacgaataactggaaagaggagagtgacataaatataatgcagagccatattgtctacttgtactgcaaacttttgatgatctgtatagatgaccagagcatccaactgagtgaggagcatcatcgcggaagacatgattgtcatgtcatacgatagcagcggagcatataaagaggatattggcatgctctgcgccgagtccaggctactgactaccgtatgtgatgccgactgcaggtgcgatatgatggagagctcagctcgcgtgggatgggtaacgttcggttctatagtgtcacgtaaatagcttggcgtgatgatggtcatagctgtgttgtgtgtgagtggttatgcgctcacaaaccacacacatacgagccggagcataagtgaaaagccggggt

SEQ ID NO: 8469 - DNA, 226 bp, Homo sapiens
cgcggccgaggtaccggtgaggaaagtgcggattgacacttggatggttgtaagtatgaatcacctgatgaggtcacaaatacaatgcaatcgtcaaactatttatagcagcctctaacttgcttcatatgcttctgtttacagagtgaatacgacccatctgctgcagtgaatgtgattgagctctcaaggtctgggcaagaggggattggtgtaagtgtatcca

SEQ ID NO: 8470 - DNA, 162 bp, Homo sapiens
gggcggacgggcctgacggggaggaggtttttgggtgtgatgaagattgtggcgtgtttgcggcattggacagcctagaagctcaggacaagtgatgactctgtattggaaagtgatgacgcaaggccgggggacgcaggggcagccaacacatcagccatc

SEQ ID NO: 8471 - DNA, 226 bp, Homo sapiens
  misc_feature (1)..(226): n = A, C, T or G
nccgnctccgggtctagnttactgggacaacctgntgntggncaggnatatggcactcaccgggctgggntaaggcacagncctgggntaactcactgggcattgggcaggctatccggcatgggctatggcacagcattcctacctggccatgacctgtgcatgctaggcacagctatttgcgtggccctccgctctgctctgtgctatggccgcgcatagcgca

SEQ ID NO: 8472 - DNA, 338 bp, Homo sapiens
  misc_feature (1)..(338): n = A, C, T or G
gaaggantagcaggnaccgagaggataccagcattactgacgaacanggaccagccccacctgggaccctcttaccccacaactctcattgggctacaccactcagtcgaccgatacacactcgacacagggacgntagggatgcaatgatcagacctcctggtagtcacctaagcactatctgggactggtttggggtaggacaaaggcagcacatcttggcaactggcacaagggcctctccaagctgtaagggcagctcaacagcacctactgggatgggtcagcgcaggggctgctggtcctaggtactctggcccggggcggaacgacttact

SEQ ID NO: 8473 - DNA, 224 bp, Homo sapiens
  misc_feature (1)..(224): n = A, C, T or G
ncagntacgncctggcgnaaggntcctttctggacgntcaaggagnatgnaatctggnaaaaactgtctattctcttagnagnagnaaaatataccccacctaaagtcgcagctaccattaacaaaaaaaaaaattagcaaagggaaagaatcaatggtaaggacagtaaatatactctgagaatagagtaagtacctcggccgcgaccacgctaatcactagt

SEQ ID NO: 8474 - DNA, 770 bp, Homo sapiens
  misc_feature (1)..(770): n = A, C, T or G
gggncagntactagnaaaggnccggnctgccatccatcgctgcctcgnaggtgganaagnagcgggtgatgtgctcacttctgatcaacatgtgttgcctcctctcagccaacttctagctcactgcactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccagggggtcagtaagctctgcctgccaagaagacacagtgagaggggtccacagtcctgatgaggtggcgtttggtaacttgtagaccctagcatggccaggtctggtcacccttaagaacttctcagagaaactaggaatcttcagtgaaagaactaatgttctcctcagctgaaattcccttgcttgtcagcatttctgcagagctcacacttgtttcaccatacctcccttggatgtgacatgtangtangaagtatgtgcangtgggagtcatctgtcagcctgctatgtttcagagatcctgaaagtggtttgaaacaaacaggagaggagcaggaaatatccgtgcctgtggcagatctcactcatcatgcttagcattctctcccgccaagctgggata

SEQ ID NO: 8475 - DNA, 226 bp, Homo sapiens
  misc_feature (1)..(226): n = A, C, T or G
acagntacgatttacagatcacggtctcaactgattttggcatcacaatataacataatttaaagtggggtgatttattcaacagtatcttgtttcgcaaactttggagacatgtcctagactgtaccttcaaactgtattcctgatcttgctggaacatgttggttgctggcggtgctggcatgcagccatggtgcattcctggtgcctgaactgatagatgtgg

SEQ ID NO: 8476 - DNA, 338 bp, Homo sapiens
  misc_feature (1)..(338): n = A, C, T or G
gnagatacgcaagnttcttttactttcactgnaagnttctgggcgcctctggtgnttttttcctntcttttctggaaccaggggcaagcactccggtctcttggcttctgcgnacggggcagnatctgagcaatgcacttgcgactattctgctcctctcctgcacaggggtaagtatcgtctctctagggtgaaggcagatctggcatttgtcgtcttcttgggactaccagaccgcgtccctttttttctctgctgcgtttcttttctcttccttatcctcttttaatctctgtccctcatacttgcttatttcatacgatgctaggttcactcct

SEQ ID NO: 8477 - DNA, 322 bp, Homo sapiens
  misc_feature (1)..(322): n = A, C, T or G
cagctgnaagctccaagncaaancaatacagnaactcatccagtgatggctgaactgtcgtcatcagctaaaacaggtaagcgaaaaagagtcagatgctgtttcgaggtttagtatatcctagtaatggttgtcctgcctgcaatatttgaattttaaatataaatctatttattaatatttaacattatttatatggggaatatattttttgactcatcaatcaaataagtatttattatagtaatcttttgtgtaatgaatatgaatatttattaatatatggattatttattatttttatatcttgtgattgttttat

SEQ ID NO: 8478 - DNA, 498 bp, Homo sapiens
cgggtacatatatcaaaggactataatataaacatgcacctatggtattatatagcaaaaagaatctatggggaacagttacttatgcacacattaacatactccctgaattttgattaacacgatgttctcatatgcatgtgatattcatctacttatttttggctggtcatagtatctgctgcatgttatcagagtttatattatcacctcgggagatacccacctaatcactggtgtattgctggcgcggtgtgagtagatcgtctgggagagctcccatcgcgttgacatgcctcggtcgtagtattctataatgtcacatgattagctggacgttctcatggatatagatgttatcctgtgtgcatatgttattagatctcaattccactcacactactatcggtatgctataatgcgtattggatgggggagttaatgagtgtatctcactatacattaattgtgttgcgctaactgactgatttacattca

SEQ ID NO: 8479 - DNA, 530 bp, Homo sapiens
  misc_feature (1)..(530): n = A, C, T or G
gncagatactgattacaacaatgccatgctctcgcagcagactcacgattcaaggtcttacatgcccgcaacatgactcacagnaactaaaacatctacactgtctaaaataagaactcaaatgtctggatgtagagactatattgagctggaaagtcaataaatctttcactataaccaccacatggcacattaatgcatcacatatcaagcgtatatagtgcctgagaactgaagaggatctgtaaacaactttcatgtgtgtaatatgactgatgtagacacgctatgcattgaagtactatctgaacagatggattacctcttgtcctagcatcatctcgactctgtcttgattatcaactgcttcccactggaaacatatgaagccgtctatttatttatgtgtgtatatgctatatgaattgttgactgtgtggaatgcttgctattgtggctattattctgaatcttaatactataaatatggatctgatatgattctgcttgtcagtctctagtgctatgca

SEQ ID NO: 8480 - DNA, 178 bp, Homo sapiens
cggccccgcccgggcatggttacataggcaccgagactgcggagtgggactctactaagtgtgtgtgcaactacatgtgcgaacgtggttttttttttacttcgtgcttgtttgacgctatggctgggagcgcatgagcacagagccatgaccgcgtgcacgccgtattcgatggcgc

SEQ ID NO: 8481 - DNA, 210 bp, Homo sapiens
cgtagtttaatatttattgtctctcttttctgctgttgtagtaccatattatatataagtaaagagatgcgttcaagatctagatcacgttctatgaggtagaggactcccttatcttgtatattcaggcggtcaagtagctatatctgagacggtcggtctatattgtatagtctatgaagtcgtgtgatgattctcaatagctctatg

SEQ ID NO: 8482 - DNA, 546 bp, Homo sapiens
  misc_feature (1)..(546): n = A, C, T or G
tggcatatgctgtattttattgtatcgtgtaagtgctagaaatatacccaatactgaaatcttattaactttgttttctatgcggcttggggttttggttgttcatgcattattgtccactattatcatttttctttaacaagatataacattgtatggtatattgtacatatattgtatgcatccattactggtgtgtgtttactactttggctgttgtgcttaacgacacatggaactgtgcaatatcgcttttatgcacaactctcggcttatttaaccaagaatattatcgtgaaacatcgtgtactggctaataaggcatattctcgtattctttgtaatgtgatatagtgatttcagatagctttaaagtgtatgtgtgacattcgtgacaactatccaacacatacttaactgtgccaatatttgtcaatttttatatctgatgcatgcgttcctaaaaaatgagatgtctctgactaacataacaggagtgtcaatttgtggtgcgtggagtgcaatgtagtagtgtcgnactcagcg

SEQ ID NO: 8483 - DNA, 338 bp, Homo sapiens
acgaggattagaaaatcactgaagtgactgttgatgacgtaggtgaagagtgggaagtagaggaggtgtggagattattatttaagtattttatgaatgctaagtaataggaagtggttgatggtgatatttaaattttgattttgttaaatttgtagtagaatattgattaatgattattttatgtggtgatattgtgatgtgctttatgttgagcaaattggatattatttattagtttgtttttgaagtgtcttactatgtgagatgagaggtatagtattgtgttgtgtgtttgttgttcatattgttgtgtattggatttagttttctttgaa

SEQ ID NO: 8484 - DNA, 177 bp, Homo sapiens
gatgcctgtgctcactgtccacgagtgcactgaggcacaagggcatgaatggatcctataaatgactcactttgcctggctcttggcactggatgtagctgttggggcttgacaatttagaacttgaagccctcacccattatccggaatattgtgatcctgactactattccagaa

SEQ ID NO: 8485 - DNA, 306 bp, Homo sapiens
aagatgtgatgaagcagaacgatgaattaatagatggaagacatataacatgcgataaaagtgatacgtgtcactatataaagagtaaagcccatacaagtatccatgctttctaatctcaacgttgtaagtggctgggcaacctatgcgacgtcttacacaaggacacaaagacatgagcatgagctataagggggctccaggactacctctaagagggataggcctctagtaactccaggctctgctccgaatgctgagaggagacttaaatactgttactgcggcccgttacatcagaactca

SEQ ID NO: 8486 - DNA, 162 bp, Homo sapiens
tcatgaatctccaaccttaaatactgaaacactgacatatgaagctatttgatgcctgcttgaatcaatatatcaccactacttgcggcactgatgacactatgcaaagttgcgtgatacgtccgaaacaatgccgtagggggggctacagggcacgaaaca

SEQ ID NO: 8487 - DNA, 162 bp, Homo sapiens
  misc_feature (1)..(162): n = A, C, T or G
tttttttttgntggtttaaaattttaataaaggggggncaaaggntgnaatggntcnaaaantcctcaagntccgnacggnactccccgnagaccaagncanttgnantccattcattattcgntctggnatcttagncaaagccccggncccctggnanca

SEQ ID NO: 8488 - DNA, 194 bp, Homo sapiens
  misc_feature (1)..(194): n = A, C, T or G
tttttttttttttttttttttttttttctaattactaccttttattctaagggaaaccagggcccgaaagncgaataacaagctggncgaaacaaaggaaactaggggtggncaaaaagaattaggggggaaaaacatggnctcttcctgggggagggagncggggaaaaggnaaaagaggtgctcagccggca

SEQ ID NO: 8489 - DNA, 210 bp, Homo sapiens
  misc_feature (1)..(210): n = A, C, T or G
tttttttttttttttttttttttatttaaaaaaatttcaataaaacggccgggcgggctcggggcggcccctatcggctcagccgggggnccctcctcccccaccccattctaccaggggagattctgggggggaggccaagttcccttctagagggggcttcacccttttcccagaaacgttccagtttcaggagnaggnagcaggcag

SEQ ID NO: 8490 - DNA, 226 bp, Homo sapiens
  misc_feature (1)..(226): n = A, C, T or G
ttttttttttttccacggntacaaaatctttaggtaantataaaataaataatagnaatattaattaataacaacaacacaacagggncaacaatattaataataacaaaanctctcccatggncccacgnccttcctccancttttctcttcggcttcacacaacttgngnanatanctgttttcatancgggnaaaacggagncccananagntcgncacactg

SEQ ID NO: 8491 - DNA, 338 bp, Homo sapiens
ccaggccaggacacacagacaccacgcacacgggaagcacggacgtgcagaccgcacctccccctctctggacccactctccccagctcgccagctcaagccaggagcacacagcgcgaccccagcccaccaccaagaggacaggacaccgagatgtggaggcggccaccgggcagacaaccgaggcgacaaaccacagaaccggctccacacgtagaagacagcacacaaacgcagccgatcccacaacagcacgcagtaccctccagccgagccacacaagctccacccgcccccccagctccacctgccgcggccccccaagactgccagccacc

SEQ ID NO: 8492 - DNA, 594 bp, Homo sapiens
  misc_feature (1)..(594): n = A, C, T or G
caactctgaatatactaaaagctgttgaattacacactttaaataagtgaattttacggtaagcaaattatatcttaagacattaaaaataataacaaaggacggaactcacacatcttctttagacagaaatgtagtctcactgcagcaagtatggcttaaacctgcttctgaaccgtgcacagttgtaggcctgtctcaagtgttccgtcgttgacttgtgtcccgcctcgccgggcaatgatgtatgtgtggagcgcagtcatgttctttgttacgcaacacagttttcaccttgggctaagatgatgtgattcttccaaggtttgtggcagaaatcccatttaatanactggtccagatttcttcatgccgtaaaattgtttaaggaagttatttattctgccaagctctcgtcatggtgtccgacactcccttctgtctcctggagggccaggcttccgtgctctggggctcagcaggacggggaggacgtatncctagacacctgcatcagtcaaggtcatggatattgggaagacagacagcagcagacccaggtctgagcttacaaggtagccactgagtctgggg

SEQ ID NO: 8493 - DNA, 434 bp, Homo sapiens
ccatttgctcactggggctacagacgcttttctacctgcaatgtagatagactggatgccactcgtccttataattgttaactttttactgttatctttaacttgtgtttaacctcactttcatacactttagaagcaactggaatgataatggttattgtgaacaaggggcaaatctgcatgtgtgcagaatataatcgagttatctttcttttactgatactgaccccacatgtgtttgacctttctatgcacactgttgcctttagaatactaactgataaatcattttactgttgcttttctctcacatgttagcttaacgctgaacggcattttgactacagtgtgttctgcatatagaacattgattacacatgatatattggtttatactttttgttgtctcttgcttatttagtttgctgctcacg

SEQ ID NO: 8494 - DNA, 386 bp, Homo sapiens
gtactctctattacatcacccatgctaatattgatgatgtatcatctctatgtaggaatcgacttgtatcacctgcattactgagtgacgcatatgagatgagatgactgctgacctgttcttgtggcaccctggacccactaaagaacgcccttagtgatgaccaactgccacatgttacacattcttgatggttggctgtgtggcggaccttctcttgtgaccatgatccagaagctcctccaacactgcttcactggaacactgctgcctcagacgataccacgtgatgaagttgtggcttatggggcagctgcacgtccgagatttttgacagctcacaactctgagaatgcatagcttgagttgcctatggaggcagctaa

SEQ ID NO: 8495 - DNA, 642 bp, Homo sapiens
ggttcaagaacctgctggtttctggatgcgtaagtcacacagcctctgctgtgtgacactattcttgcttctgcctgtcatctgtgatcatatgccaggctcgtgccagaatccctttcttatactgatgtggcgtgatggatccgcatggggctgctctcctggaccttcgtgctgtccttatacctggtttggggagcacggtgtggatgacgtgagcgtgtgatgaactgcatggagattctgcggcaatagtgacacatgtggctggtgtgcttgagatatgggatgagatatgacatgcggaactaatagcatatgctttgtcatcacgatggcaaaatcactgagagaacagagaaaaaaacatagtactgtgtcgtgatcaatctaatccatgccgtatacgtggtcgacggacaggctacaatatggatcagcacactatgagtctgatgatacggtagagcatgcaatgatgatgacgtgatgggactcggcgtagtcatggctatagctgtttcctgtgcgcagttgccttccgctcacaattatacaaaacatacgagcaggaggcataaagagtaaagcctggggtgcctaaggagtgagctaactgacattattatgggttgtgcctgc

SEQ ID NO: 8496 - DNA, 530 bp, Homo sapiens
attggtggtagctcatacatagatacttggtcatatctgactcactgcttggacttctgctatatcactgcataacatggcggtgggtggttggtgtgatgtatctcattataggagttgtgtgaaactcattacgaatggaatggatatcctgatagtaacaacatataccatcacagaccgcttattgaaagcagtactatatattaccaaacttggccttgttgtctgggatgatctggacgacatgtgggtgatagaattggttgagaacatggacaagatattcaacgtgacatataacatgataccataacaaccctacaggaacatagctttcgactgatacaggtgtgactctgactggctaggatgctctgacacactgtacgtctacatacaaccaggtgattctagtttacacaataatggactgagatgatactaactgtggatgatagcactgtatgattaaaatgatctcttaggatatttaaaatagaagatataataaaaatatataaaagctt

SEQ ID NO: 8497 - DNA, 162 bp, Homo sapiens
tcgacgtatactatgatcttcttatctgtctttcgtgtattaggtagtaaccttatgtatatgtctctgctagtcattactgctctttatacattgatatagtctgtcgctggcagggatgtaaggggctctaatgggcatgtatctagctgatgctctgac

SEQ ID NO: 8498 - DNA, 162 bp, Homo sapiens
ccaaaagactgctggagaccactcaaggcaagacatgaatgtcaagtttctcaatagcaactaaaaagaaaacgaggactgactctcgaaacagctgactaatcattcggtatactgacttgaatgcccaacgcaaagcaatacatgaaaccacccaagcga

SEQ ID NO: 8499 - DNA, 354 bp, Homo sapiens
agtctgactattaaatgaatggaaatgacacccaacatatacagtatttatatgagattctgactgtctacatggatatcatgcgcggctgggtaaaaaatatccgtggatttgcacacctgcacaaagcacaccaagaactgctttttgaatcatctctcttataactggttgcacttccatgatcatacacgtggctagcgagtggtaggttaactcatatattgcaatggggtggtcttactcatgttgtggtgcataactggattagaggaatggacctgatgaatctgttgattatggcgcaacttgccaaacatgaatcttgactggtacacgactctgatgaagtgc

SEQ ID NO: 8500 - DNA, 466 bp, Homo sapiens
ggtacacatagggcactgaacatcttacttctcgtgaggattactgagctcgctgcatgtgattcgtgtgctcacactccactgtttaatatgttactatgacacacctactaaaagtatgacagctcctcttgacctggaagtgtgcaattaccatcacacgtggataatgcaaggcgctgctctcatttcctgttacttatgactgtgacgtgaagtgagattatgcactattaacaaatcatgatggtggagatgaaagtgctcatcattacatacaatgtgattgatacacagatgtgtgacggattgctgggataaaaatatatgtaagattaggactcctaaccgctggtttactcaatcataaacagaacaatgatcaaaacagaggtcacaatactgcctgaggtggctggcatctctacgacgcacgagtgcactgtacaccatgcctgcaaacgga

SEQ ID NO: 8501 - DNA, 178 bp, Homo sapiens
  misc_feature (1)..(178): n = A, C, T or G
ccngggtacatcccattgatgtcacttcgcaagagtgggcatgaccatattgtgaatctatgagtacggactattgaggactaaactggaaggatgcaactacacacactgtgaggaatggctgcgtctcacactagtatgctttattacagggactggacactggatagaanataca

SEQ ID NO: 8502 - DNA, 594 bp, Homo sapiens
  misc_feature (1)..(594): n = A, C, T and G
cgaggtacaggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttgaaatctggaccagtttattaaatgggatttctgccacaaaccttggaagaatcacatcatcttagcccaagggtgaaaactgtgttgcgtaacaaagaacatgactgcgctccacacatacatcattgcccggcgaggcgggacacaagtcaacgacggaacacttgagacaggcctacaactgtgcacggttcagaagcangtttaagccatacttgctgcagtgagactacatttctgtctaaagaagatgtgagtcctaagcagacttaaagccaagaaaataagaagaggaaagagagaggcctgccctaacccactgttgtgctgacttggacaattccaagtccaagaggactgtctactttcgaccttgtgtgattataacct

SEQ ID NO: 8503 - DNA, 178 bp, Homo sapiens
aggtaaatatcattgatgtgagtttcatactacagcatggatgtggtagtgctgcagactggtgctgcttatggggcagatacactagctctgatgtcaatgactggaacagtgtgattggatgcctgatggatgatttcttagacatgctaaagtgtaagtcagaccctgactcagt

SEQ ID NO: 8504 - DNA, 258 bp, Homo sapiens
ggggcaggtaacacctccagacctctttctgtctgagtgtatctagtttgctgcttttatttatgtattatgttctcctcatgtacttgctccttgctgctgggagaattctgtcgttctctttggccgatctcaaatcgtagaaccctaaactacttcctgcagtaactgccctggcttggcgtctcacaaggcaatactctcctcgttccagcgaggaccagagggtagcccagcctcccagtgtagctggactcc

SEQ ID NO: 8505 - DNA, 210 bp, Homo sapiens
aggtactggacctaacctaatgtagcacatggggacacatcgatattacaacaaagtctattagacgaccacgaaatacataagcacatataatgctgattgtaaatagatatccaaagcacctctgctacaaactacctggctcgtgtctgctgtatcttgccatccacatgatagggcatgtaacacgaactccagagcaatctcctc

SEQ ID NO: 8506 - DNA, 321 bp, Homo sapiens
gtacttgtgtgtctacagtcacggttgactatcccactatgtttactataaatgaggctctgtgattcactgcatggcagcaggtgatggcattgacataggccactgcttgatatgattttgtgcatcctgtccagaggtcctggactttatgagaggtatgtttaggcatttggttgacatgctatctgtctacccgtgtccttacgtctgggatcacatattccttctgtgggtacaaattgtgtgtgatttctgatgatagggggtggtgtataactatttatcttaacactggttgtatatattacattggtttaa

SEQ ID NO: 8507 - DNA, 290 bp, Homo sapiens
  misc_feature (1)..(290): n = A, C, T and G
cgggcaggtacactcangaatgtgctgcacaaactctattcagttagcagtgatcaccccgtgacccacacacaccttcgatataatcctacaaagtcttaacattaattaacataattaaataagtatttgcatctataaaaaatatacagaagaactaattgtggagtaatctgtgcctccatttcaatgtctgcttgtttcactgacattatcaatatattcttttcatacaaagtcttataaaaagcgaaggagggctgagcggatacgaccagccacacacaaaa

SEQ ID NO: 8508 - DNA, 371 bp, Homo sapiens
  misc_feature (1)..(371): n = A, C, T or G
cagntacaancttttttttttttttttttttttttttggtttggaacctttaataaaaataaaaaaggaatgcaaaaagaacacaatgttgaaaacttaatattaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcacacctcggccgcgaccacgctaatcactagt

SEQ ID NO: 8509 - DNA, 194 bp, Homo sapiens
  misc_feature (1)..(194): n = A, C, T or G
ttactaatttacttagcaaactttatcctgagatttgcaaatttaaaaaaatgaagaatcaaactatattttcttttctgtttttttgaaacagagtctccactctgtcatccaggctggagtacctgcccgggcggggtgttgtngtggttatgaatttgtgtgggtgtgaagtagagattagagataggatg

SEQ ID NO: 8510 - DNA, 162 bp, Homo sapiens
tttctgtgtaataagagtgactgcttataaggagcgtggattgcgatagagtattgtgaataaggttgtttctacttaagtagatttgtgtataggcaagagtgatgtatctttgttatagtttaggtgtatgtagttattgataatagtgcagcgttttta

SEQ ID NO: 8511 - DNA, 274 bp, Homo sapiens
  misc_feature (1)..(274): n = A, C, T or G
agcaaaacccacccaagcaacaactggggccaagaacggggnaacccaaataggcattaccccagaggaaccgaattaaggaaaatggaattaagggggtggcccaggattttgacgaccaatttgatgatgaaggaccccttccttgccttagggactggcaaacttttttaccatttggaaggtaaaattgaaggaccaatttcggtagtggaaggaaaacattggtttgtattaaaggaaaacaaaggcaatggttgacccgctttcgggg

SEQ ID NO: 8512 - DNA, 162 bp, Homo sapiens
cttgatgattgtactgtatgtgtccgtagagctgatggctgctgtgttctatggacgttggtggacgactgtctgtagatgaggaggagatgaacagtgtggggcaggtttggaacatcttgatgaatctttgcacgctcatgtattgaaatcttagcatca

SEQ ID NO: 8513 - DNA, 338 bp, Homo sapiens
tgtataatggccctggaccatcttccatgctggataggacttataagtgtgtaatacacacgtactatgggcaagatggataaagactactgcctacataacttgtatctatatccatcacatcaaccaatgataagtacgaatctatcctaattttacaaacatggacacataacaacaaagatgtcaatgtcctcattcaacagaactgaagatagatcaaacgctaaaccagactctgtctctattccctcctgttgtgccacggtgcatctctgccgagacggtgcctttatttagttacaaaacacacttgatgtatggcctacgcgtttaac

SEQ ID NO: 8514 - DNA, 322 bp, Homo sapiens
  misc_feature (1)..(322): n = A, C, T or G
ctggtccaacagctgagggatgttgagggaatactgtactgccactcaccgaattaacgcctgcaactatcagagatgaacaacataaaaaaaaacaagaagagaaaaaaacatagttagagaacctctgcatgaatcatgataagcacatatagaagaaaaaagatataaacgtggtagcgtcaatccgagagacgacatcgccatgcggtattgccagcaaacacatatggactggacagcnagacatggatcataatgatgaatgatcatgcgctactagactactgatcaatgggtggacatagcagcanacactcac

SEQ ID NO: 8515 - DNA, 786 bp, Homo sapiens
  misc_feature (1)..(786): n = A, C, T or G
ttttttttttttttttttttttttttttagtttaaagactatttcagttttagtcagactacttcagacctcagactccagacttcagactccagactttagacaacagactccacatgccacacaacagactttcagactccagcttcagactccagactccagatcgcacacttcagacaacagactctagacaacacactccagtctccacattccacacgacagactacagactccacactccagacaacagactccacactccagacaagagactccacaatccagacaagagactccacactccagacaagagactccacactccagacaacaggagacttttagactccagatcagacttcgaacttcagattcactccagacttcagactccagaccagacttcagactccagacccagatttcagattttagacttcagactccagaccagatttcatatttcagactccagaccagacttctgacttcagacttcagactcctgacccctggcaacatgcacatggcangcccttcacttagctggtagaaggaacacaggcttgggaaggagatgtctgatgttcactccctgacgacactcttacttgcttcaatgatctctctgagccttgggtggcccatctgctaaacaaggatgagttatttgctggggatgctaggagacttctgcctcatgcctgcagtgctgctcatgttgcccccttggaattacttgttcaacttctttctttcccactagacggggactttttt

SEQ ID NO: 8516 - DNA, 338 bp, Homo sapiens
cgagtactcttagtagcgcacgtctttgttgtatgcctttgatgggggctgctgaacgtctttttcaaggatcatggatgtctcatggaggaattaaatctcatgggtattgattcattgcttcacggggctgaagaataatctgtgggtgatgtcctgattgatgctgatatgacacatctttgaggtaagaacttgtttatgtccttgaactggatgggattgttctttgtgacctcatgagtatatacatgatgattcagctgtagacatgtgtgacatctcttatggttaacatggaggtggacattatacctgatggggcgaacagctacttt

SEQ ID NO: 8517 - DNA, 274 bp, Homo sapiens
tgaggacttgatagcatgtgtgtgtggactgaaatgcttatctcttccggagatgtgacgaaacgcctggtgtgtgtttgtgtttgggctgagactgtatagagctggtagtttgtagcatgtgagagattggagtgagtctgtgtggcttaactcctttctcgttcgtctgcgcataccggcatttagtctcgtgggttgattatggaacttgcatgtgaggctggatattgatgagctgtgtgtagtgcggctgatgcttaatatagagtct

SEQ ID NO: 8518 - DNA, 610 bp, Homo sapiens
gaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggagtggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgaacatcagatgggacctttcagccaatttctataattattgaacagcttttcgtggggccagcacaaagtctttaactgctcatagtagttaagaaaagatggggatacatttc

SEQ ID NO: 8519 - DNA, 162 bp, Homo sapiens
taccaacaactcttggtaaagatcacctccgcatgcacagagtgcttgacatgtgctggatatcacgcttgtcgctatacgaagggatgtgattactgtctgtaacgacccttactcgttgtgtcaataattgactcatctagacgtggataggctgattca

SEQ ID NO: 8520 - DNA, 466 bp, Homo sapiens
  misc_feature (1)..(466): n = A, C, T or G
gtacttgataagttgattctaaaatacatatgaaagtataaaggaacaagaatagccaaaaacttttgcagaaaaacaaattangaagacttgctttaccaaatatcgagatatgtgtttataggtaattcactgagctgacattaatgtgttgtgtatttttttggtcagagttgatccttactngagagtgggtatgcatgagtgtgtgtatgtgagagtgagtgtgtgtgtgtgtgtgtaaaatggaggagaggactaaaagtgtgactagaagcagctggaagtagcanngagagtggaagttagtcccctcgagtgtttgcaaagtaagacatgcctgcccagcactcttcctagtgtatagtggctacaaatagagtagagaacagactccagtcctcaaagactttcagtcttgcgagtcaactcagactcaaatgtagaactgggaaggacagtgccg

SEQ ID NO: 8521 - DNA, 210 bp, Homo sapiens
atgcacagtgcacatatctggtacaagctaaatctggggcgcatcacagccaatggtaaattctacagtcccttctcttacggatcataatgccttgattgtaagcgctgcacatacctcagggtcgccatctactgtagataaaaaacaactgtggatgactataacgccatgtgcagtctcatggggtagaggcttcactcgtttaac

SEQ ID NO: 8522 - DNA, 514 bp, Homo sapiens
tgcacattagtacatttttcttaatggtgtaatacttgcgtgtagctgaaccaatcatggatactaccatatcataaaagaacatgactatatctccgtctatcatccattaaactattacctttcacagctaaggccttgacctatgcctgaatgatgctgttacataagctgagataatacagccatttctgtgtcatccatcaggataaacagtatccacgttctacgagctgtgtagcgtgcaaccaatgccaggagtacatactgtatgctgtggtcggagcttctgctaaccactctatcatgtggaagatggataatagcttatgggggaagccagacaagattgataaaaccactataggtgcattgacatgtctagctatgtggtgaggaatgtgactatacatcgtgtgatgatagttgggaagtatgcgctcaatataggccatctgctggtctgacagaatctcagacgtgaccacgctacgtaccagccacggccggccgg

SEQ ID NO: 8523 - DNA, 322 bp, Homo sapiens
acttgatacaggctctgacaccagatgacctgtagagtggccacagaaggtgggcaacacactaatagggtacggtggaaaaacatatggcggagagagtgacatgatgatgatttcatttaggaagatgactacaaatctatcataattgtacaatgtacgtactcctagcatatcgcgtatatgaccgtcgatcatttcaacagaaatgaaagcatggatgtcacgctacactgagcgtaatgtatcggatgcgctggctgtttgtgcgcgctgctgcagtcgtgtgcacgtagcggtgtgcgctctgacttgacgtaac

SEQ ID NO: 8524 - DNA, 210 bp, Homo sapiens
agtacttgtttggtggacctgaacctgattctctgtgacagtggcgactaaaattgtggcaccgcacttactgtgtacggaggaacaaacagactggcgtaggcactggtctgtgcatgtttgcatctataaaacagactacaactgtatcgtgattctacgtggtcctcggcctggcacactgtaatgagtgctgaattcgtaggacag

SEQ ID NO: 8525 - DNA, 178 bp, Homo sapiens
agtactggtgtgttgaatcggaaacctgatttactgtgcagatggccgagataaagaagggcacgtactaatagggcacggaggaacatagagacgagcctatggcactagtaaatgcatgtattgcatgtataaacaggactacaaccgtattctgatcctacagcggcccgacgcc

SEQ ID NO: 8526 - DNA, 306 bp, Homo sapiens
aggtacacactatgctgatggcacttagtaagtccagcgcatagacgagacagactacactagactctaaaatctgcacacacttcacgaaaattgaatggtatgtggagctgagaactgatgagagtgatcagatcacttcattgcaacagatatgccgtcagatgacgaggcacctgttcaactgctaagagccagacgtgccaacatgtctttacataaatgggcatatgatgacccacgagaaaggacactaagttacactgtgaaccgtatgtcatgaatgccgtgtagatgacgaccaag

SEQ ID NO: 8527 - DNA, 626 bp, Homo sapiens
  misc_feature (1)..(626): n = A, C, T or G
tgcaccataatccctgacgtagatgaaatgccagtgtcaggagaatgcagacatactcaatgacaacatanattataagatgaccactgaagtcttggaggctgaccatgatgtgcaatgatgagaatgataaaataaataacaatgagcttgatactgttgaatagatgttgcagctagacaagcaaaaatattgagaaagctcaagaaattcaatagaaaatgtgggacgagttagatctatggcattccacactaaatgtagctggattctgaaggttcagacattgttgaacaggagccaggacacgctcacgactggatggataacttgatgattgctttccagcagtatcagcaggtatcacagagagcagagtgtagaacctcacagttgaatagagccacagttaagatggaagaatatagagaccttctgaagagcactgtagcttggatagaanataccagtcatttgctggccaatgctgctgactatgactctttggagacactgagtcaccatgctagcactgtgcagatggctttagaagattcagaacagaagcacaatctgttacattgaatctttatggatctagaagaccgtgaatagtttatgaaac

SEQ ID NO: 8528 - DNA, 690 bp, Homo sapiens
  misc_feature (1)..(690): n = A, C, G or T
gcggcgcggaggtgannnaccatagtgccctggcanaagattgaaatgcgccaggtggnaaggaatgtcagaaaagctttataagacatagatgagaagattancaatgaagtcttaaaaagctcaccatcatatgcaatgangtagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcangacattgttgaacaggacccaggacaggctcaagantggatggataacttgatgattcctttccagcagtatcagcaagtatcacagagagcagagtgtagaacctcacagttgaataaggccacagttaagaatggagaatatagtgaccttctgaagagcacntgagcttggatagaaaataccagtcatttgctggccaatcctgctgactatgactcttttgagacactgagtcaccatgctagcactgtgcagatggctttggaagattcagaacagaagcacaatctgttacattcaatctttatggatctagaagacctgtcaataatttttgaaacagatgaattaacccaatccatacaagaagtaagtaatcaagt

SEQ ID NO: 8529 - DNA, 562 bp, Homo sapiens
  misc_feature (1)..(562): n = A, C, T or G
gtacaccatagtccctgcagacattgagatcccaggtggaggactgcanaagagctatatacaacatacatgataaggagatcagtgaagtcttgggaagctcaccatcatatgcaatgatgagaaaaatagaagaaggtaacaatgggcttcataatgttgaaaagatgttgcagcaggagaagcaaaaatattgagaaagctcaacacattcaaaagaagatgtgggacgagtcagatctatggcattccaaactaaatgagctggattctgaagttcgagacattgttgaacaggacccaggacaggctcaagaatggaggataacgtgatgattcctttgcagcagtatcagcgagtatcacagagagcagagtgtagaacctcacagttgaatagagccacagtgaagatggaggaatatagtgaccttctgaagagcactggagcttggatagaaaataccagtcattggctggcgaatgctgctgactatggagtcttggaggacactggagtcaccatgctaacactgtgcagatggcttgggaagatcagagc

SEQ ID NO: 8530 - DNA, 194 bp, Homo sapiens
tacactgtggaagctgcaggagtggtgaccgcactcggtggactgtctaaggactactgaatcattatctagacaacacaaccagtgagtctgtgagacggaagcactataagcactgatgtagtaatgataaaggaaggtaacatatgcagcttcatgaatgctgtaagaagatgtagcgacaagaaggaaga

SEQ ID NO: 8531 - DNA, 194 bp, Homo sapiens
actgtgggtgctgagtagtggactggacccgatggcctgttaagcccatctgtatcagtcgaacaacacagccatgtagttgtagcaggttgaactgacagaatggctggtgtcgcgcagggcagtacataacctgaatcgcttatgcatgtgttgcctagacacagagaagcaattcaataaagtatgacccc

SEQ ID NO: 8532 - DNA, 402 bp, Homo sapiens
  misc_feature (1)..(402): n = A, C, T or G
acacggtgggaggctgagtaggggtgacgaacctgcattgactgtatataccatctgtcacattatatccaacacaagaatatacactatagcaggttgaaattatacaatggatgttgtatctcagatctgcacataacttgcacaactaattgatgcttatataaatacataaagaataaatangacaataagtcacacttgaatatacgttatgtgatgatgagagcactgagagtgcgtccagatgtcctcagaacatcactgagcaggaatgaggtggctaatactctatccactcagacataacagacaaacgaggcacacgtgaacagngaccgaggatcctgactagcagactagggttgccagattcaacagaaaaaaatccaggattgacac

SEQ ID NO: 8533 - DNA, 178 bp, Homo sapiens
gctcaattgatacataggtaaatatacataacccagattgctactaatagaccaaaacatcgacatatgcctattgtcacgtatatatactactggcatagtgtatatctattgaaagttgatgggatggcacttcttgtcggataactgacacaaaagtgagggactcatagcaata

SEQ ID NO: 8534 - DNA, 178 bp, Homo sapiens
agtgccactgagcacagaggacacatacctgaccgatatgtgactaagatctcaacctacgacctgtggtcattgtaacggtatctagatgtggataagcgaccatcacactagactgtcgtgctatggtcccgctggtagggacctctcacctggggagtgccgactaagcttcctc

SEQ ID NO: 8535 - DNA, 450 bp, Homo sapiens
gagtactactgaaatcaagaatacatgtctgtcggataggtgacagagtaactctacgcagaacgtgagcacgttggaacggatgcagatatgtacataagagaacatcaccaaagagctcgtggcccatcagcgcacgtagaagactaacatactagtgaacgaaagcccataatgcacctcctcaatggttaggcctgtagcacacactcgcttgagaccctgacccgctaatgctacagacccgagaccaccggcaccctgtacctcggtcgtctccacgctaatcactactgaatacacggacgccggctagtctacgatatgggcatagctctcaacggcgctggcagcatgagctgagtattgtatagtgtgatcgaaatagctaggcgtatgcatggacatagctgataactgtgtgaatacagtatacggttgaaggtacct

SEQ ID NO: 8536 - DNA, 161 bp, Homo sapiens
gtgccacggtgccggaggacacatgcctggcggatatgtggactcagatctcaagcgagaacctgggccaggcgctacggatgtagatggacataagagaccatacacacagacttcgttccacgtccacgctggtgggaaacaatcatactggggaacga

SEQ ID NO: 8537 - DNA, 226 bp, Homo sapiens
atgtgctgccgatgtcataagtgcatggctgttgggatggccgcagaagtggctcgaacagacagtttataagccggtacagttaggtggagcacataaacaaaaaacacacaggagttctttccacatcatgacctcggtgaactgaatcattgtgcttactatggcttatgtctacacccactcgagtatgaccatacagaaccatactcagcagacagacgaa

SEQ ID NO: 8538 - DNA, 370 bp, Homo sapiens
  misc_feature (1)..(370): n = A, C, T or G
ccgacgtgtgcgtaaagacgggtgtcagtacagactgtgatgaaggctgttggagagactggctggaagcgtatatgacgttgtacaagacgtgatacacatagataatatatacacgctgctaactgtgacacatcatgataatgtactgtacccgtggtgttgtgctctagcttgcttttgcacgcacatngagtacgtaacatagatcctgaacatggactgaccagatccatagtagaatctgaacttgtacatctcggcgcatacagtgcatatatacacatgatgctgagccancacacaaggtgctgggagctgtggactagacctactggcagctgctgactcaggaacggagcatgagtgc

SEQ ID NO: 8539 - DNA, 162 bp, Homo sapiens
atatcggtagtagcagtgcaccgcgaataggtgttagctcaagaacgctctgacatgctacgcactatacctgaacagcgccggggaggatgaggggctcatgggcaagatcagcgtggaggactagaagaaagttctggacaagtgatatgaagttttata

SEQ ID NO: 8540 - DNA, 178 bp, Homo sapiens
actatgagatatggacacagacggtgtgagtgtgtgtgtggggaatgcgaaagcgggttgctgcttggtgcgttaggtgataaggcaaactagctgaagtgtttatcgtttgacattacagtgttgtttgttagaagtgtgatagctcataggtggtgactaatattgttttattgag

SEQ ID NO: 8541 - DNA, 194 bp, Homo sapiens
  misc_feature (1)..(194): n = A, C, T or G
taaactagacccaaaccacgacactcctcatcacgcaccccaccaggtaacagccttaacgctgcatacaaagtggtaaagcgaagggcacgcaacctcatataaagagacctgtgtgatcctcactacccagcgactgccggataacacaatcaacacctacaccatcacggcaangactacacgcacagcca

SEQ ID NO: 8542 - DNA, 226 bp, Homo sapiens
  misc_feature (1)..(226): n = A, C, T or G
actacatgatgcacanaaatactcgcactaaaacaacacacataatcaccactattgtgttctatgacatacatgtgttacacatgatcatactaatgttaataaggcaatgtaggtaaacactgcgcatacgaaatgccacctaaaacgtgcaagaaagaaggacagtggggaggagcaaggacacaataagcagctcttgaaaggaaccaatgaagcacctata

SEQ ID NO: 8543 - DNA, 178 bp, Homo sapiens
tcaggcggatctaaatagattagttaagaaaaaagatatgggtgtgatagtccgcagtgagatgtggtgggggagtgtggcttgcgtggagaatgggtggttttgaagactgagtgggtatggggcgggggagggagaggcgtgggtggctgtgggggtatggggggcggggtgacgc

SEQ ID NO: 8544 - DNA, 210 bp, Homo sapiens
gtggttattgttgcagtatcggcatgttaagatgaaactattctgccatcttactattattgtatgtgttttcatacattggagttgggggatggtttatgttggattacttaaagtaaataatacttaaaatccaaaaaaaaaaaaaaaaaaaacaaaaaagcttgtacctgcccgggcggctgctcgatactgatggtgtagtgtggg

SEQ ID NO: 8545 - DNA, 610 bp, Homo sapiens
  misc_feature (1)..(610): n = A, C, T or G
caggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttggcagaataaataacttctttaaacaattttacggcatgaagaaatctggaccagtttattaaatgggatttctgccacaaaccttggaagaatcacatcatcttanncccaagtgaaaactgtgttgcgtaacaaagaacatgactgcgctccacacatacatcattgcccggcgaggcgggacacaagtcaacgacggaacacttgagacaggcctacaactgtgcacgggtcagaagcaagtttaagccatacttgctgcagtgagactacatttctgtctatagaagatacctgacttgatctgtttttcagctccagttcccagatgtgcgtgttgtggtccccaagtatcaccttccaatttctgggagcagtgctctggccggatccttgccgcgcggataaaaact

SEQ ID NO: 8546 - DNA, 311 bp, Homo sapiens
cacatctgtagactacgtgttgcgtggagaaggtgtctgccatgtacgctgtgtacttctacggcttcaacttgatttagcgccgtggatgatgaggggctcaggggaagaatgaatgaagattgatgaaacattgtgttggtcaagtgtggagcatgggtgtcgtggctggacgcaactttgttggctgacaatgtgcagtttaagcacaacaagaaagagctgaagcacgtgtgtaacaccatcatcagctgactgttgctgagatgtagagcggctgtacctcggccgcgaccacgctaatcactagt

SEQ ID NO: 8547 - DNA, 306 bp, Homo sapiens
caagcttttttttttttttttttttttttttttttttggaattttaaagtttttttattttgaattaaccaatttaaaaaatgggctggggttaagggttttaaaaaaaaaaaatagtggtaaaagggcggtttaatttattttttgcttgtaaaaacgggaaaaaaagcaggttaagtccttgccggggggggggttggaaataattatggaatttgggggggtttggagggggagcttagggggaagttccaaaggggtgggttgaaaagttggagttttttttggggttgtttaaaaagttgg

SEQ ID NO: 8548 - DNA, 194 bp, Homo sapiens
cactctgatggtgctattattgtggcagtctctttcctttatttgaacttatctttgaagaaaagaatatggcagatgctgacatagcatatgaacattaagttgaggagtctttattagctaaatagctcaaaatacaggtggtgaatgttgagctgcctattgatggcatataggaatgagagatacgtgaa

SEQ ID NO: 8549 - DNA, 226 bp, Homo sapiens
agttggcaaaagttcactctggggaattttgtgtgtgtgtgtgtgtgtgtgtgtgtgtgtgtgtgtgtgtgtgttttgggaaggggtggttgaggaagaagagtgctaggctggtgttttcttactccaaaatggaaatactgcccttgattcattctcacacgttatgtgaaaatacatcatagcagtcttggaaaagatctacgtcttggttctgtttagattt

SEQ ID NO: 8550 - DNA, 178 bp, Homo sapiens
tgtcgtttgtggggtggtttgtgtgttttggttgtcttcctgattctggtctggtttttctctttttggtgtttttctattgtcgatgtggtggtgttgcttgtttctggttccgttggtgttgggttctccttcgtggtgttggttgtgtgctgtgttactgtttttctctctgctg

SEQ ID NO: 8551 - DNA, 546 bp, Homo sapiens
caggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttgaaatctggaccagtttattaaatgggatttctgccacaaaccttggaagaatcacatcatcttagcccaaggtgaaaactgtgttgcgtaacaaagaacatgactgcgctccacacatacatcattgcccggcgaggcgggacacaagtcaacgacggaacacttgagacaggcctacaactgtgcacggttcagaagcaggtttaagccatacttgctgcagtgagactacatttctgtctaaagaagatgtgtgagttccgtcctttgttattatttttaatgtcttaagatttatttgcttaccgtaatattgacttatttaaagtgtgtaaatcaaccaccttta

SEQ ID NO: 8552 - DNA, 258 bp, Homo sapiens
tatatgcggagatggactctactctgctttttcctataggacttcatgtgtgtgtgtgtatgtgttaaagatgtgttgttggtttccataagggaattctggaaatcaaatgtggtatgtttatgtgtacttgtaatcaggttgtcagtcccttgctgatatggctttgttttgtgtagatacgaaggaatcttaatcttcggggtgggatgaagagagaattatctatattctttgaacgcgttgttttaagaatca

SEQ ID NO: 8553 - DNA, 626 bp, Homo sapiens
atttaaaattagtcccctttatgcattttactctacatgtgttatccttgcaaagaaaaagactgacatctttgagagcaagagtttttgtcttattcacctctgtataatttccaacatcgtgctttgcacattggacattcaaaaaatgttatacaagattgactgcatcaatactggagtgttgtgtgagggttaggtgctgaggctgagaagtgtatgagggagacctgagattaaacctgccacataaagtggagagaagtagcaaggtcagggctatgaaataatcccaaaaactttagaatttctacataatacagttgacactactattctcaatagagctgctttcagtctcaaagggctgtggtatgtgtgcgtgtgtgtgtggtaaaaaagggaagcagcaggggaaggaagagaagtgtgatttcacaagacttaagtaatcttgtcattgctgctttttctgccagaaaattattaccttccctttaaaaatcattttcatatacattttactaacttccatgtcaatttcacccttttttttctaataatagctactatttattcgggaccaactagtatacttaggactatgctgggtgctggagtgccaa

SEQ ID NO: 8554 - DNA, 402 bp, Homo sapiens
agacacggggtgactgaggaggaagttagacggaggacagggaacgaaggggaggcaaacaagtcacgtgagatatggaccaattgcttaaagatgctacaacacatgtggaaaagtctctagcatgatggcagggagtggggcgatgtatggatactgattgcaatgcgcactgagtcataatctgggcaaaccatgaggccgacatctatatccgaagagcggaaactacagggaggatgtgttcggtgctgactatgtgaatgatctaattccaccagagctgcaagccatggaccatggtcatgcagaggaagatgcctaccacacgctaaggataaagccagatgacctgatatgtgacatgggagtctaagatgtctgctccttgttctacatatc

SEQ ID NO: 8555 - DNA, 290 bp, Homo sapiens
gtacaagctcttacttctattgatcctgtatgatctttcacggttctttcttgggcctcaaaaagagacacttattaatagaaaaaaaatgacaaggatgtccatcctttggctcccttccctcccccctcctgctgctccctaacccccactatattgagccatggctggggctgggtggcaggacagcccaaaacatgagggcaacaacattgaggggcataacactaatggaggtgtagcataagggcccaatggctcgattagacctctggtctctcacagatatt

SEQ ID NO: 8556 - DNA, 658 bp, Homo sapiens
  misc_feature (1)..(658): n = A, C, T or G
cagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctgnaagatactttctaaagtcaagcccatcaacagaaaatatgcactttccatcctccatttcaagtcagacggagcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagct

SEQ ID NO: 8557 - DNA, 546 bp, Homo sapiens
acacgtgcagcatgtcagctcagagcaaacgtaggggcctgcggccaagatcagtgtccattttggccattacatatgacttcataaagtgactttgttggtctgtgatgccagctctctgaaatgtgcacactaacataaactgggatggaatacggttcgtgtgacagactctggaacaggctctgtggtaccagcatatatggaggagcaaaggaccggagctgagaatgagccattggcgatatgaagaagagctgggtggtgcactcgggcatagatcgccaggcttgtatattgcacgtgtcgcatgctctaggcacgttccactgccaagtgtgactaggaaaatgaccacaccgatgtatataatgatgaggaatatggagcttgcgagcctactgtggacatggctgtggagatgatgggtgagtactgtatcgaggccaagcacagatagtctgggacatggtaatgaacgagtcggtcacgatacagatgcagatgttatgcagcatgtcagctgtactactatgagacgacgga

SEQ ID NO: 8558 - DNA, 450 bp, Homo sapiens
tgaatttggataatatgtgactgaaacacgagtggcaataaaaaagcaaacatgaactctggggtttaatagatcattacatcagtatcatagaccatgtgactgtggggcttataacttgtgtagcctaatgaagtgccaaaaaagagaattatgattcaaggggagcggatgaacaccactattacagttacagtttatgctgtatatggattacatcaaacaaacaaagaacttgcttgcgaatatattatatatgctctgtgaataacggatatgtatgtagtagactgtactcatgctaatccaaaatgctcagcgatatatacacgaatgcgactggacaaactgattccttcagttactgatggaagggcggcacgatcttctgaatatattgcatacctgacatactgacgggaagaggaagtgatgagaagcctataaaaa

SEQ ID NO: 8559 - DNA, 274 bp, Homo sapiens
cacatggggattatattttgtattggcaaaatgagaccacagctggcctgccatcagatcaacataaaaaccagtattatggtatatgagatgaatggatagaggtggggtttattccttattatagagaaacaaatgtatgtcttcatcagtcttattagggacatgaatagacgaatgtacaagtggcttgcctacgagcctgtgcgcttggcctacgagatcaatagggggagacagaaggaataaacgatggggtctggacaactgaggt

SEQ ID NO: 8560 - DNA, 178 bp, Homo sapiens
acggggggaggcctttcgtgcgagttttgcttcacaaggaaattagctggaaaaggcttcttaaagaaacacaagggaaaaggaaatagggcacaaggtattattgaaattcttttaaagagcagtaggagcttgaaagtttagaacctccattatgaattccaaccacggaaaagcc

SEQ ID NO: 8561 - DNA, 194 bp, Homo sapiens
gggtacacaagttcatacagacatctgtcatattctgagcagcacatatgagagaagctttgtgttctccttgctctcttgcatgtttgttttgagcttgtggctccacagagactctcatggatttatgacaaaattggcatgcgaatgatttttgaatcataacttgtctattattatgctgtagtgtggta

SEQ ID NO: 8562 - DNA, 322 bp, Homo sapiens
actactgtagtactggaatttttattgttttaaatgggtagaaaaatggtaatataataatatatgatatataaactttaaatgaaaaaaaatgatgtattgtagatatttgatgtagttttattttttaaattaatcataaatcagactttgattgtattgtagtgatatatgactttgaatatattataaatgggaaatgttgattttttaataatagacttatatgtagggtgttgttgcggttatgttgtgtgagtgaagtgtttggttttatttagtgtggtggggtttatttaaagaaaaagaaggtagtattagg

SEQ ID NO: 8563 - DNA, 354 bp, Homo sapiens
gtgctactgggaacataatgggtcaggtggctatctaacacgaatgatcaatgtgactacatctgaacatggtgttcagtgtgtgagactcacacagagctttaccagggtgtgaagatctgctgtgtgtgcgagcttcttctattaattaggaggactctgtgatggactgacctggatggcatatatatgggtcgattgcctcagcagatgagtatctgcagataaagcgacgttatgaggtaggtgaagatcaagacaacaacataccttatttgggacgactgagtatacacagttaatgagcataaacgaaatgttatatatgatgagtgagctgatggcgagaaacag

SEQ ID NO: 8564 - DNA, 226 bp, Homo sapiens
gttttttttttttttttttttttttccagctcaacccttctttaatgtcatccagggagggggccagggatggaggggaggggtggaggagcgagaggcagtgattggggggtgggattgaccacttgtgccatgaagaggggagactgggtatttgggtcaatcatataaaaagacaagggggtgggcgaactggacctggggggggataggacggggcatgggc

SEQ ID NO: 8565 - DNA, 370 bp, Homo sapiens
acagaggacgggaacaacaaagagtctgtgaacacacatgcaaaaaaactccataatcttatgtacgcagactgaataatgatctgctgggatgggaaaatgacgcaagaacacggatgtcacgaaacataccgtataaacgaggtggtgaatgaatgtaaagaaaagctgtacgtagtcctgcagaggatgtaacatgaagatcaagcagctgataagctggcagatgacatcacacaatacataacagcctgcaacaattatatcagatagagagacagaacattatgatgaggaacaatgaaatgatagtgatacagacaacgatgtagagaccatagcttgaaatgatggaagaaagtgaagtgaa

SEQ ID NO: 8566 - DNA, 226 bp, Homo sapiens
caactaggaaatatcggagaatgagactcagaagtatgctatgggatgctaccttgaagtcagaataacgctgtgtttaccatggaataaacgttaaattactgttgctttttggataagtatgtattacggcatgctgcacgataacaccttgtcgatttaaatttgattttttgttttcgtccatctaatgcattacatgctcatctcgaaagacttaaaatat

SEQ ID NO: 8567 - DNA, 194 bp, Homo sapiens
  misc_feature (1)..(194): n = A, C, T or G
acggatgatgaaatgatgacatcatctacgagtgcatgcttgtaaaggacagcttagaacagtcctatatgaacaatcacacctatcatgactggataaangaggcctagcgttgggactgatacacacacaacaacacagtgaagatgtttattngagtgtatttattctgatgccataggtaatgtagtttt

SEQ ID NO: 8568 - DNA, 578 bp, Homo sapiens
ggtacaatacgtgcatcatgactgtcattagaaacttggggctatgtggccaagttcactgttcattttggtttttccattttcattcagaaagtccctttgttggtctgtggagaaatatatatggaagtgtcacagtaacatacactgtgatgtaatgtgttttatgtactgtttttgagacaggctctgtgacagtgatcatatgatggaggagcataggacgagagcagagaaagagtcaagataaagccgaacaagaccggaaatccggaattgtgcacagatagataaggctaccctagtcagtgacgcaggatacagaagtgcttgatctactgtgcttaggtgttttatttatatttagatgaaaaaaatgataaccaccatctaaagtcacagagatgctgtgaagagatgtggaagcaatgtgagtgttttgataataacataaaggactgaaaggggggaaatagtagcctataaagtagttaaggatgcatatgaacataaaaaaacagagcaagaaaccggaaaaaaagaaaaagaaggagggaacgaagagcaaaaaaaagaga

SEQ ID NO: 8569 - DNA, 226 bp, Homo sapiens
aaaaaaaaaaaaaagctagaacaagtcctatttgttttttttctttttttgtaatgtgtccaatttattcaagatactccaaatcaaaaacagggcacaacaccaagcccgcggcccaacacgcgacggacaagctgaaaatgttttttaagcaagtggtgggtatttttgttgaggcgcgacgaagagagaacaaaaaaccacacaaaacaaacaacgaaaaaga

SEQ ID NO: 8570 - DNA, 194 bp, Homo sapiens
acagtcacagatgaaacaacatttgtaaggaccatttatgtaaactgctgagatgttatgttttcattttggttttcacagacacattcaagctctgtccgacatgccattaaagcactggctcagaccgcacgcatattttcattttttaagtaactggtaagtattttttttctcacaaacgcacaccggta

SEQ ID NO: 8571 - DNA, 274 bp, Homo sapiens
cagggactcgggctaagatcatgtgaatccagtggatgtgggtcagatatggacagtgtgtgactagttgcattaatctatgactgaatgctgagacacacctggcggtactagaaggaatgaacccacaaaggaacgcaccagcaatgtgttcatgacacatatgatgttttttagtatatcatacacacgcgagaatcatcactcgcagacttagcggcagagaactatagagacgacgactgtcagcgagcagccgaaggtggcactccaa

SEQ ID NO: 8572 - DNA, 274 bp, Homo sapiens
gtacaagcttttttttttttttttttttttttttttttttttttttttttttttttattttaaatcaattaaagatttatgaaatttattggggtacagggaataaccgggacaaaagggggagaaaagttggtaaaacaagtgtattttaaatattctatacaattttttttgtgtacatatttggaagtgatgggtatttaaaaaaaccgcatagaaatccacaaccttaaatattctgcaaaacaaaacattaggttctctcttccttaat

SEQ ID NO: 8573 - DNA, 162 bp, Homo sapiens
gttagggggaaaattattaatgattaatttttattttggtgtgtattggtatttgtgtttcttattgtatatattgtggaaggtgttgggagtgaagtttttgatttagagatttgtgtgagttttattattataatgattgatagttggtagaataaagta

SEQ ID NO: 8574 - DNA, 274 bp, Homo sapiens
aaggcttttttttttttttttttttttttttttgggtgggaactcatttttttattcttatatattatatattggatatctttacgaatgggatactttccatttggggtcagtgacaggtggtaaaaaaatttggaaacatcaggtctgaaatagtctgagatggtatggacttataaggggcaactggcacattcaaggactgtatgaaatggcattaaaggactgggttacaatggaggggtatctctaaaccgggagtaactggaacgca

SEQ ID NO: 8575 - DNA, 354 bp, Homo sapiens
ggtattgattatggaaaaaatgaatctgtttaggggttttttcccttaaaggaagggaaggaatttttttttatgggaaaaaacaatagttaaaaaaataaattgttttttgggaataaataacacgttaaatggaatggtataaaatatagatattttgttaaaaaagtttacctttgggtataataacaaaaaggggaatgggttttttttgtaatgaaggccggggtttatgtggaagcaaccaatattaagggggttgggctgtcgatttagctttgggttaaaaaaaatggttttggggctgttaattgttatttttaggggggaaaggggggtagaaagttgttttaa

SEQ ID NO: 8576 - DNA, 434 bp, Homo sapiens
gcacgattaggaatttatgcctattatcatagggatcgacatggtcctcttctctctcacctgtgatgctactgatatcttttgtcatctttctgattgtgggatgaggaaagtcttcatgtttttatgatatctctaatcttgtacacctcggaggaggtgtgttttcatctggggcacttgtaatggtggagctttgctcgatatgccatttttgcactggataagatagtaagcatatttggcaactggggggcaactggatagcataaattaaatcttaaatgctggttgtgccatctatggaagtaaacataatgaccaggggataatgcctaggctgggtgagtatatcggccctgaaatataggcttgtatgggcatattcttggactaattgccacaagacgaaggataaagagaaaatagaacag

SEQ ID NO: 8577 - DNA, 242 bp, Homo sapiens
ctatgttttgttgattatgttgtattagttagaatggtattgttttgtttttggttgttgttaagtgtggtgttgtgtggtgttgtgatggagttgttttggtagaagtggtgtgtgagttgatcgatttagtaggggatgtttgataatgggttaaatttatgtatgttagggtaatatgaatgatttaaatgattttgtgtgaaggagagattttatgaatgaaaaaagaaaggtaaaat

SEQ ID NO: 8578 - DNA, 450 bp, Homo sapiens
ctcggaggtgttggcttggttgatgcttcgccaggtgaggcgattggtgtgtgcgtgtcacatactttttataatcacaattcacatccagtgttgagcttgcggcgttgctgtggatgaacatgccacacactgtccgacaggtggagagatattgtgaaagtgtggggattggtgagtgagtggttttgtgtgatgaatctggcgatgtactttgcggtcggatgagtggtgtctgaatgagtgcgtgaaggctctgacatatttgacaggagtggtgcgttttgtggttagtgtcaccgtacgtgatactgatatgtgatagtggaggagatgattgtgtatattgagaggatggtgcaagagtgaagtgaaagagagaaaaagttgggagggagtggagagattagaggaagatgaaaaggggatgtggtgtgtgtgtatgtgagc

SEQ ID NO: 8579 - DNA, 290 bp, Homo sapiens
caggtacaagcttttttttttttttttttttttttttttttttttttttaatttaaatgaaataaagaatatgaaaattttttgggttcaggggataaagtggaaaaaatggtggaaaggagtggttaaaaaaggataaataaaatataataaatattaaggttgggtaaaaatttggtaaggaggggtatttaaaaaaaatggaaaaaaattcaatacttaaaaatttggaaataaaacaaattagtttttttttatataaaaaagggggggggaatgtggtggggtta

SEQ ID NO: 8580 - DNA, 402 bp, Homo sapiens
aagcttttttttttttttttttttttttttttggtttaaaggtttttttttgaaaaaaaaaaaaaataaatggggttttcatgtttttggaaaaagaaaaaaaaaagggaagggggacattcccattgggggaaatttttctttgggttaaattattttaattatgggaatgaaaacttatatcaataacaagggacattaaaaaaatattaattaaaaaaaagggaagggaatggggggagggagtctggggttgggagggaaggggtttatgggaaaacattcggggttaaggggactttcctggaaaatttctgggtttggggagattaagttaatttcagggtattcaaatttctcgggcggggggccgatgcaccctaatgattcgacccactagcc

SEQ ID NO: 8581 - DNA, 226 bp, Homo sapiens
gtgtttttggatataatgaaaccttttaagggggttttacgcttaaaggatggaatagaatcttttttatggcaaaaggataatgatctaagatataatttgtgtggtgtgtttaaatcacgatttccaatggaatgtgattaatatctatctgtgctcacgtagtcttctctgtggggtcatagggataagtgcgattgggtctcgtttgtagctaacgagaggg

SEQ ID NO: 8582 - DNA, 338 bp, Homo sapiens
gcacggaggatcattgttctctcttctttctctgcaggcttgacaagtccatcttatatctttggtatatcagcatccgcacgttcatgctggctaaagaagctatcttggatgattacattacatatgttagtcttattgtggggatactgttttgcggatgatggttgtttgaaagctgcgatttgatgtaccaagttttgattttctgccttttaaatattttgttttttttttctgttatgttgtagggtgatttgttggtggttgagtctttctttaccattattgtaacccttgtttatttttgggatattttatgtattgtatttaatttt

SEQ ID NO: 8583 - DNA, 466 bp, Homo sapiens
  misc_feature (1)..(466): n = A, C, T or G
cccaagactctcatgattgttcgacctttggggctatttgtatttatgacatcattcaaatacctgctttttgaaacactaatgcctacctgccctgggtggtaacaatgttgtaagggttgctcatttgagtgaatgtattttatatttttttcatcttggtactagttttttgttatttctttcgtaatattctacttgggtttgatgtatggctactatctcttatgttttcactcatgtacttangggctttttaggttttagttgttaatgtgtgtggtattttgttctctatattgttcatagatattttatttactgattgtagtgttgttaaatttagatgatttcatgatgaactcattaaccaggaaatggacgtgcgtaatacgtatattttttgtttttgactgtgtgttctttaataagttcttgaattttctattgcgagtgttagatggag

SEQ ID NO: 8584 - DNA, 210 bp, Homo sapiens
gttgtgtttgtggaaatgtgaccttttttgggggtttttgcttctaggggagtggatggttatgttgtttatggaatgagaatttttatgtaaaaaatattttgttttgtgtgtattaaaagggttattagatgatgtgttcttattttatatttatgttaagggatggtatttttgggttttatttacaagagagtgttgggtgtttgt

SEQ ID NO: 8585 - DNA, 338 bp, Homo sapiens
  misc_feature (1)..(338): n = A, C, T or G
ctggccttcaaaaagtcgtagtggctattttttttggacaaaagtaagaaatgttgttttaggagtaacacagttcaaaagagctttaaagaagcatgcacacttatcacaaacaactctntcaggtggccagtctgatcttggatataattcattatctaaagatgaagttagaagaggggatacatctactgaagacattcaagaagaaaaagataaaaaagggagtgattgtagttccttgtcagagagtgagagtacctcgggggaagaagcatgcatgtctgtgctgatcccagtgaatcctgggtccaggagtacctgcggtatttattttt

SEQ ID NO: 8586 - DNA, 210 bp, Homo sapiens
gggttagtgaacttgtgacttttgcatcctaatgtatgctaaaaaatttttacttccaacaccatgatattatgagcgactgttttgtgcttgctaatgatgctacctgggctgtgatctacacagactgtaagtctcattggggacaaactgctccaaggaactgttgtgattgtaacgctgctatcgggatgaaacctggcgcttcag

SEQ ID NO: 8587 - DNA, 466 bp, Homo sapiens
tgattatggaatcgtgaatatatacaagggttttttcccgtataggaattgaatgcactatttctgatgtgggacacatgctctttgatataatacattgatgtatgtgattgaattatgtgtctcattgatgatgatatacatactttgatatacatgtaatgtcttctttatagtgtgatgtatgatagtgcaattggtcaccatttgtggctgaggctaggggtagtttggaggattccaatcttgatatatttagagtatgcatcatacttttggttgaaattattcttgtcttgtgatatatcagatattagctcaagggacttgttatcaatgtttttgtcgaatgactttgatgatgttgctatgctggcacatctctcagaagatgtcaagggcacattctcagattgctccacatcctatgcattctattgaaattctctggctgcgtctcatcaca

SEQ ID NO: 8588 - DNA, 178 bp, Homo sapiens
gggtagatcagctgcgcccatcatctccgactgcatgcttgacaagtcacatacttacaacacacgtatatcaccaaccgcaccttgatgctggctacaagagctaaatagggagataacaacacaccgtacggacactggggacatatcgtaacacaggagtcataatggagagaaa

SEQ ID NO: 8589 - DNA, 530 bp, Homo sapiens
gtacaagcttttttttttttttttttttttttttttttataaaacaacgcaataccaacgaaatatgagacaaaacaataaaaaccaaagaaagaagatggggatagtagaaaaaaccaggttgcttgcaaaaaagacacatattaccttaggtccccccaaagataatgatggactttgaaaaaaaccaaaataaaatacggaaaataaatattaaataaataaaaacataaaacctactgttataaataacataaaggagagtttaacttggatgagatgcttaataaaattaaagtatgatgcgataagaataaagaactattaattggacaagtccagagaggcacaaattactatgaacactaaaccctccatgatgggcaagaggaaccggcaaccccagcggggaggtttatggtctggggggacgtccgattccaggggagaaaaaccagagcttgtaaacgttattgagacttctactggagagacgcacaatatatttcacaccaatctgttgtgggagg

SEQ ID NO: 8590 - DNA, 386 bp, Homo sapiens
  misc_feature (1)..(386): n = A, C, T or G
taccggttggggtcccaagtgacagtgtaattccagggggaggtggagcggctctcgatgttacgtgacatggaaacgcgctggttttcattgatgatgccaatgtcaagcttcatactacctcctggcacaggcgggcaactctcangcttttggaaaaaagtatgtcctactttggggattttccgagctgccgcctcactcagaaaggcaagccccaatatcgacagcagcaagtacttgaccatggctgggccatgcagggtcttcactgtcatgttgcgctggtggcttactttgtgcaggaagctctttctgtgaatgtatcttcctgaccctgccgggcggaagataaaacaaaaacgagaagaacaagcaagacaaga

SEQ ID NO: 8591 - DNA, 162 bp, Homo sapiens
tattaaaaaacctaattcttcacccaatttttttaatctgccaggaacacccaataatatttttaaatatatcactttaatagacttttcttttagatgtcttttcttgtaaaggaagaggtgatatgttttcatattgatgtgcttaattcaagttgatta

SEQ ID NO: 8592 - DNA, 386 bp, Homo sapiens
tttttttttttttttttttttttttttttttttttttttttttttttttttttttttttttttttttttttttaaaaccaaaatattttttggaggattatttgggggtttttttaaaatgaatggggtggtggaacagggggcctttggggtttgggggggggtcttttgggggttccatgcctgaattggggggattaaatttttagggggcctattcgaccagttggggggggtttttgttttttaaccgtgggccttccaattttactttttttggggcttggggggggagcccaatttggcacagggggatttttggaggggggggggcttaaagccacaggggggggaaaaaggggggctttcattgggaccctctaaaa

SEQ ID NO: 8593 - DNA, 162 bp, Homo sapiens
caagcttctttttcttttttttttcctttttgactttatcacaaaagtccaaattatgacccatgaaaaaatagagcgaaataaccttactgatgaaagaatacatggacctctgcatagatcacaaggacatggggggagaagggcgcgcccacgccgcct

SEQ ID NO: 8594 - DNA, 194 bp, Homo sapiens
  misc_feature (1)..(194): n = A, C, T or G
gaccgtcctaagtaatcacaccgtacactgcacacaaacatgggcaaccagcagctgctcctgcatgctttaagtgtaggaatnacatgaacatgaaatagtggacaaggagaaacaacaggccaaggaaccagctatcataggacaagacagaaatgaaaagacatgaccaacgtactggagcggcgtgatag

SEQ ID NO: 8595 - DNA, 402 bp, Homo sapiens
  misc_feature (1)..(402): n = A, C, T or G
tgcttaaccgatggctctgatgtggtcagtgaccttgaacacgaagagatgaaaatcctgagggaagttcttanaaaatcnaaaagagaatatgaccaggaagaagaaagggaagagaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaanagcctgaagattcctggcttatagcatgcgagcattgaaagaccaatagcaaacttatcagtacctgcccggcgggcggntgcaggg

SEQ ID NO: 8596 - DNA, 210 bp, Homo sapiens
tttttttttttttttttttttttttttttggtttttttaagtttttaaactttttatttgcataataaaaaaattgtgcattccaataattaaaatcatttgaacaaaaaaaaaaaaggcactctgaataaactggattacagcctggcaggacacctgggccagcttggggctactctaaaatccactggcggcccaccccacctcccc

SEQ ID NO: 8597 - DNA, 210 bp, Homo sapiens
  misc_feature (1)..(210): n = A, C, T or G
cccacactgtcaaatgtcaactccaccagcatctganaacaatgagtagtatgatgaaatgtagaaagaaggaaggtggtaggtaaaggagcggaatgaacgagtggggaaaggaggaaggagaganagagaaagaggaagagaaaggaagaagaaaaagacagcatggcccggcctagacacaaaaccaggaggtgatcaagctcagca

SEQ ID NO: 8598 - DNA, 210 bp, Homo sapiens
cgctgattgaaacaccactatattttctggatttaaaaaaaccttctactacccctcaaaatgaagaaattcgatgagttgttatactaataagatagcggcctatgactgaaaatgctgtccgccaaaatggacgactggtcaaaaatgacacactgtatggacaatcaacaacacacaccacccccgaaagcaacgccggcaggaccg

SEQ ID NO: 8599 - DNA, 290 bp, Homo sapiens
gaggtcgagtcctgctgggcttggcaacgagggactcggactcggcagcgacccagaccacacagacactgggtcaaggagtaagcagaggataaacaactggaaggagagcaagcacaaagccatgatggctacagcgtgtgctggtggaaaccaagataaagatgcccattttgcaccaccaagcaagcagaggctgttgtgttgtccaaaatcaaaactgcacatcaacagagcagagatctcaaagattatgcaagaatgtgaggaagaaagtttgtgggaaaaag

SEQ ID NO: 8600 - DNA, 258 bp, Homo sapiens
cgggctcggaggccgcttcacgttcacctcccacacgcccggtgaccatcaaatctgtctgcactccaattctaccaggatggctctctttgctggtggcaaactgggtgtgcatctcgacatccaagttgggggagcatgccaacaactaccctgagattgctgcaaaagataagctgacggagctacagctccgcgcccggcagttgcttgatcaagtggaacaaattcagaaagagcaagattaacaaaggtatt

SEQ ID NO: 8601 - DNA, 338 bp, Homo sapiens
aagctttttttttttttttttttttttttttttttttttttttttttttttttttttttttaaaaaaatgaaacattttttttaacagaaagagggtggggggggtggggtaaaaaagggtttttgagaaagttttaaaccgacccaggtcttgggggaaatttttggggttaggggggggggaaaaaaggcctaagctttaggagggggaatttgggggttttttgtggttttgtttaaaatagaattttttttggcttttttttggcactggtggtggggggggggggggaaaaggggggcacaggtttctgtttttgttttgtccccagatgttt

SEQ ID NO: 8602 - DNA, 162 bp, Homo sapiens
gaaggcatgatgttttgattttttttttttatttattatgctaaataagggttaaacagtgctacaagccggcaaacaaatagtacggatttcacgggagaagaagcaggaccacggcgaatagaaatgatgccgaaccaaaaagctgagaacatgttggga

SEQ ID NO: 8603 - DNA, 402 bp, Homo sapiens
tttttttttttttttttttttttttttttttttttttttttttttttttttttttttttttttttttttaaaaccaaaaaatttattggatgattaatggttgacttttttaaaatgaatgggatggtgcaacaggggccctttggggtttagggggggttccttcagggaatccatgcctgaattggggggatacaatttttaggggccttattcgaccacttcggggggtttttccttttttacccttggcactccagtttttcttttttttgggcttggcggggggcccacattggccaaagggcgatttttgaaggggggaggccttaaagccaaaggggcgggccaacgggggggttttattgggacgctttcaaaaagaagaagtttcttttgtta

SEQ ID NO: 8604 - DNA, 494 bp, Homo sapiens
tacatcttaaataagtctaataattttggttcatcttaaagtaaaaatacattgaaatgaatgagagagatctagattttaaaaaagttgaccattcattattgctggaactgaagaaaggaaggatacactggcatcacgatttgtctacataagtccagttcatctcgcgtttgttttggcaagaagaggacactacaaaactcacagtgcagtcaaaacaaaacaaaacaagaaaaaagcacaaaaatggtcggtggggaaccatataacaaaactacatctcaggcagctctttctcaaggaagattctaagattttattatgtggctaattctaaattggaaatggaacatgccggtatgtgaagcaattggtgctaggactttaccctttgctgatatgcaatgataatgtgatgagctttagtgactcttgaatcaggataatcacactctttaggtacctcggccgcgaccacgctaatcactagt

SEQ ID NO: 8605 - DNA, 178 bp, Homo sapiens
  misc_feature (1)..(178): n = A, C, T or G
ctctngagcttgtatggaggtaagagtagaaacaccattatgattgtaataaacgagtgcttgaatgatctggttatgggtggctgatatcacactatggtgtagctcatgtgagtgatgctcatgatgctagtaataccgatgtggttatggatggagactaatanggggattgatc

SEQ ID NO: 8606 - DNA, 194 bp, Homo sapiens
taaggaaagaagtaagaatgaaattgaagaaagatgattatgaaaaagaagggagaaaaagagaaaaataatttttttatgtttttatggttttatttttttttgatatttttttgattaaatttattttttatgaaaagaggtttgtgttgtttgttggatttttttttgttgtataagggattgtttgttga

SEQ ID NO: 8607 - DNA, 306 bp, Homo sapiens
gtactgtttggtaccttggattgcatgagttggtgggggccggcgggcctagccactgggcgtggaacgacaccggtaatagtgttgatggagtgtggaatagctgttacccttcactatgaccgctataacacatgctgaacgatggatcccattgcacaattgtatagtgttggaggcactactgggagcgattcttatacccaacaagcgatacaccgacataacaaatggtgggatgggtataatgatcatctgtcgctgccacatcgataaatactgaattgatagggaatatgttggttg

SEQ ID NO: 8608 - DNA, 306 bp, Homo sapiens
  misc_feature (1)..(306): n = A, C, T or G
gacgtgctccacgtggaacggtggttccatactgtcccttctgtacactatacaacgnatgtgagaagcaaaacangattatgatgagatatggccctacatggtttaccgacatatgcttatatgaaagactatgacttattctgcgttacatcacctctgttgtacaagatggtaacttgcgtataagacatgatgagattggtgtggttttatttgaatttttggttttgatttggtggttatttttatattgtatgagttgagtattatattttagtaacggcaaatgtgtcacccacattg

SEQ ID NO: 8609 - DNA, 242 bp, Homo sapiens
gggcaggtgtacgcgtcgttatctaatttttctgaatcggaggccaaaagaacaaacaagggcacgaaaataggccatgccttttttggacatttataaaaggtttttgttttattttatatagatggttgattatttatagtggtgaacagttgtataagatggttggttgttgccatgtttttgaaaatataatggatagattgtgttcatggaattggtttatattttgataatagaat

SEQ ID NO: 8610 - DNA, 226 bp, Homo sapiens
  misc_feature (1)..(226): n = A, C, T or G
ggctactgntccaaggaggtaaaaggtagcttactggttgtcctcccattcaggttanaaggagnaggtctgcggnctaggnagnntcaataaagtggattggtcttagtggggcgaaatattatgtnctttgttgtttggtatatatggnagggatggggnattattgtctaggtatgagggatggtatagtgaataggggcaaggcacgtcctccctagttttg

SEQ ID NO: 8611 - DNA, 194 bp, Homo sapiens
  misc_feature (1)..(194): n = A, C, T or G
gctgcaacggctattattcatcctagtgggntaatggagcantaggttagtattttgcgttgctgggtttggtttaatccacctcaactgcctgctatgtaggcataatattgagtatagtgaggagaaggcttacgtttcagtgtgggcatagtattgggtatatggagcgtagatggtggactgtacttgtg

SEQ ID NO: 8612 - DNA, 274 bp, Homo sapiens
ctgcaagcaggggggacgagcaacgtgagatgagcaggggatggccaggtgaagcggctggagatgttttaatgcaccgtcgcagggtgcaaatgagagagatcacaagcagcaaaacaactggatgagacgatgggaggggcaaggatgccagatgtcaagagatccatagcgctgagaggaatgtgggagggggatgctagagtcatagtaaaggggaaaccctatgctagctgtcaacagagttcacagggggtacgggataactgtcggt

SEQ ID NO: 8613 - DNA, 157 bp, Homo sapiens
  misc_feature (1)..(157): n = A, C, T or G
gntacatggncctgnttctcctatatggnaanaaaaanacatcccgcccctgnaatttcccagntcctctgnagnatttaatgggtgcctaaggagcatataatgaatgtcattgccatttacgaggtacctcggcccgaccacgctaatcactagt

SEQ ID NO: 8614 - DNA, 177 bp, Homo sapiens
ctactgttccaagaatggtaaagaggtagcttacgggtgctcctcgaattcagttaaaaagaaggggccggcggctaggaagtcaataaagggattggctttatgtgggcgaaaatattatgcctttgctgttgggcatatatggcaggatggggaatcacaccaccaccacaacct

SEQ ID NO: 8615 - DNA, 306 bp, Homo sapiens
taggggggggccccggggcgaggggccacaacaatgtaaaggcttatgctgggaggaaaagggcaaggttttgccggtgtttttttaaaaattatttttttgataggagggaagaaccggccttcgaagggaaaataaggtacctactaaaaaggggcccccttaatttaaggttaatgtgttaaagggggatgcccgcggtccctgggcggcaacaacgtaaataacaagggaactgggggccgcgggaggggggaaaataggggaaaactcccaaacagggggatgaatagttgggattttata

SEQ ID NO: 8616 - DNA, 466 bp, Homo sapiens
gatgtgattatcctaattcaagagtcactaaaactcatcacattatcattgcatatcagcaaagggtaaagtcctagcaccaattgcttcacataccagcatgttccatttccaatttagaattagccacataataaaatcttaaaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcatgatgccagggtatccttcctttcttcagttccagcaataatgaatggtcaacttttttaaaatctaaatctctctcattcatttcaatgtatttttactttaaaatgaaccaaaaaaattaaacttatttaaaaagagaactgccggg

SEQ ID NO: 8617 - DNA, 402 bp, Homo sapiens
cctgggaagaaaatttggttggtggagggaaacgggggcagctccaaaagggatgctgttgttaggggcttaaaaacatggcctgcccccgggaaactgaacaagggatagagggggagctccccaaggctcctgtgtgttttactaaaagggcaacagtctcaagtgggggctggaggggaatacactgtttttaagggttagggaaaagagggtgaggggatggaattgaaaaaatatatttatttttaaaaatattggggagggaactctctactgaccttggaaaacgggaaacaagtgggcccctggggcgaaacaaccctaataactagggaattggggggcgccgggggggcaacactaggggaaagcccccaacgcgttgggagaatatctgga

SEQ ID NO: 8618 - DNA, 338 bp, Homo sapiens
ggcacgcgggcggggtgggggcgcacacccccccttctggcgcgcgcgcggtgagggggggggggcgtgggaggatggggggatacagtatcaaatgaaaaataaatgttaaaaaatcaaaaggggcgggctccttaaacaattttggcgggccaaaatgtgagggtatggaggggagggaaaaaaaaagggggggggcatggggggcggtgggtatatggttctttacggggggggggatagggatggacgcagcgggggcgccccctacgacaaaccacccgcaccctgccctccacacatgcggggctctctaaacatggcttccttctaagaac

SEQ ID NO: 8619 - DNA, 258 bp, Homo sapiens
tctggtcaaaagtcaaaaaaatggagtttacaatgggcataaatgtaaaaagtgactcaaatgggaggaaaacctgggggggaaggaggtatgcgggtgagtaaaaacttgcaaagcaggtggttaccctttgccatggaacgctcgccttaatacacctgattaagcacacaaggctggttgaaacattaggcagggagggtttgtgtcggctgggcaggaaggggggcatcacgctggaagaggaaagcagcgact

SEQ ID NO: 8620 - DNA, 242 bp, Homo sapiens
gctggtctggacggtcaagaaaatgcgggataaactactcaactggctactacgtggaatgacactgttatcgtcatcgtacagaacgacgacatccaaacgcatattgtagagatacggaccagtgtatggaccagggggatcgaggaaacccgcttcatctaatatgacctacacttataatatgttgaatgaggatggtgagtggtctgagcggaaaaaggggacccactgataagagg

SEQ ID NO: 8621 - DNA, 226 bp, Homo sapiens
  misc_feature (1)..(226): n = A, C, T or G
angaaataagactgagggttctatctacacttgtagcggacatcaaacaactaatgagccaattcctcctgctgcaactggtctaacggatgcagcagtttatactgatcgacatgatctctaaagcccataagccgaaaaatggcatctgagatatgctgggccaggtgatgttgtgacgagatgtcagtgatcagatcatctaccttgtcataggccatgaact

SEQ ID NO: 8622 - DNA, 162 bp, Homo sapiens
aattgccaaatttgggaaaaacacttgtgtgtgggccaaaccctgtggttaaaagaggttaattaataaatttactgacggggggaggggggttaaggtattgtgggttaaaggactgttgcgtaaaatgtctattcgctgcctacggctgccacaaaagcc

SEQ ID NO: 8623 - DNA, 194 bp, Homo sapiens
tgattagagagacggggaacagagccgcctttctacttggttgggcgtgttttccctggtcttattgtttgttctggttttaagctccaaaaaaggggggggccatgttatcttcaatatgttttggttgtgggggcgggtggtctttttatgtgaccaacagatgtccagaaaactagggagggaattttatt

SEQ ID NO: 8624 - DNA, 498 bp, Homo sapiens
caccctaacagagggaaattttttttaaaaaaataaataaaataaaaacaataagcaaagaaaaatggatgtaataggggtgggtaaactaaaaagctacaaaaaatgggtccctccacggaaaaaattatggaactgtaaaaaattgtgggaagaaactatttggaatttctcgagtttagtaaaacagggaaagaataagggaaaaagtgggataaagaggatgataaatttgggtaagggtgggggaattcaagccttccaactaaataaaacctattttccataccccattatgggggggacccaggggaacgggggcccatgttctggaaaggaattcggggagcgggggggaaaaaaaagcactttttggccaaaatataggggttttggtggtttcgggcctttgaaggcggggggggacacacagaagggggctataatggcaacacccctaataaagggagggggcttcaaagggaatttaaaaaaata

SEQ ID NO: 8625 - DNA, 514 bp, Homo sapiens
aaattcttttgtgaattatcgtgaggaaaaaatattttttattaaagaaaatctttaattaaacgagggggactaaaaccaaaaaaaatttaccaaaaagttaagcaccttaatcaatgggttcaactctatttttcgggcggggggaaaaaaggggggaaaaagccggggagggttggagggggttttttaaattttaaaactaattataaaaataacttgggagggggaaaaaaaaggcttaacccgggtttttaaactaacagcacagggtttcattcaccctttttacctaccccaaaaaaaaaaaaaaaaaaaaaaaaaaaaaagttggcccctgggggggacccacgctaataacttagggattggggggcggcgggggggccgaaattgggggaaagctcccagcgggtgggaggaatagttggatttttttttagggtaacttaaatagttgggggtatttagggatatggtggttttggggggaaattgtgtaccgggctcaacc

SEQ ID NO: 8626 - DNA, 178 bp, Homo sapiens
ctgtgttggtgggggggcgaaaaaaaataaaaagaagggtcttgagtggggtggaaagagggggaaaaaaaaaaggggggggaaaaagggggaaaatagggggggggggaaaggagggggcgcgtggcttttttggtggttgcgagaaagaaaaaaaccccttttgagggacgcgccc

SEQ ID NO: 8627 - DNA, 482 bp, Homo sapiens
aaaaaatgggttaaaaaaaaaaaaaaaaaaaaaactggtgctaacattttttatatttggggttttttttttaataacattaaaaatggaaagagtttttattttaagtgcctctggggttaaaaacaacctccatctccttggttaaaaaaacgctttgggcccctggagggaaaaaaatctgtgaggggtgggaaaatcatccaacccggaaaacatccttcaacaaaccgcccaagcaaagagtatgagggggggacatcaaaattagggtggggattttaatggaaatctctctcataacctcttttctttgggtctacagtaggggtaaaaaactccaaaggggatttaaaaaaaccaaaaattatttaaagggcccctcgcccgggaccacgccattctttagggatcgcgggcccgcgggcgggcggaccatggggaagaccccccaacgcgtggggtgcattggttggttttct

SEQ ID NO: 8628 - DNA, 482 bp, Homo sapiens
tagtgcatagtttttattatattcgttttccggagtggagcgcgtgtttgttccgtttgtgttcgtctaagacgtgaagaaaagctgatggtttgtggtgtatatatgttacacactgtgtggagtagtgggcatctgctaagtgaagcccacaagcactgtatttatccctgacctgtatactaccatctgctgccctccctagccgcaccaatctactaccttataccaagtattgcggatatgatcacaggtcataccagacaatgcagtgaacaagtgaaagaaatgcatgtggtgtgaagtgtgatatataaaaagcccatgcagaataccattgatgccctgatggaagagaaaatggcagcaaaaatttcattattctcacaagcctgaaacgcgtgaattacaagggcttaaagaaatactaatgcctctaacctttcctatagctgctttttatctgaagggttccttgaatg

SEQ ID NO: 8629 - DNA, 322 bp, Homo sapiens
gttgtgacagtgaccgtgggggatattgagattgagataaccaatatcactacgggcacaacatacatttatgacgctagagcaagaggccgagaataacgtggataataaaattgacaaagacagcagaggcctcaatacccacggactcctgtcttgacccgaagtagagactgttaagtcctgatgcgtcgcctgcccttccttcattgctgccctggaatgtacctgcccggccgttcccccaaaacagcccggaactggggctggttaatgcaggtgatgaaccagtggttggtattgtgtattgttttgttttaaa

SEQ ID NO: 8630 - DNA, 338 bp, Homo sapiens
tgtgaactgggacctttagtggtgggcattcatgctgcatatttgtgtgttgtgttgacctggtggggacggaacatcgagtcctgggtcgatgatggagctgatggagggctggatgactaatgggcggcccaggccgggggggaccaaactccaacacaagacaggagcgagacgtgaggggagggagggacacacggggcggccatggacgcagacagcaccgtgggctgtgcagtctttgttggaggcggagcacaagccggtatgaggatagggataaaattaatgggtatcacttccctttttttgtttttggtatttttaaccacataaat

SEQ ID NO: 8631 - DNA, 306 bp, Homo sapiens
gtgaaaatatggtgtttaggcgttttgtggaggttggtggggtggtctatgtttttttttggatcttatgctggaaaattggtagagattgtagatgtttttgtatatgaaaagggttttggttgatggatattgttttaaagtgaggagaatggtaatgtgttttatgtgtttgatgttaattgattttatttttagtttatgtaggtgtttattatatgtatgtcataatagtttggaaaaaggcagatattatttaaaaaagggtaaatataatgatgggttaagaagattgaagatagaaaa

SEQ ID NO: 8632 - DNA, 240 bp, Homo sapiens
tacatttttcaagctgtttttctttatgtttttgaaggaccatttttaattagctctttgatacaaagtaactcagaacgtcaaaacctgtacccactaaagggaaggctgccgggaaggcaaatggaacaggaatggagcctgtctcaggaaggccagccgcaggtcctccagaaaatcaaagaagggaagaaactctgagtttgaggtacctcggccgcgaccacgctaatcactagt

SEQ ID NO: 8633 - DNA, 194 bp, Homo sapiens
gtccccctctttttttttttttttttttttttttttttttttttttttttttttttttttttttttttttttttttttttttttttaaatagatttttttttttgaattttttgaaattttgaatttaaaatgaattgtggaggggggggggagtttcaatatgttggctgtgttttgggactgggttggcggc

SEQ ID NO: 8634 - DNA, 493 bp, Homo sapiens
acatattaaataagtctaataattttggttcatcttaaagtaaaaatacattgaaatgaatgagagagatctagattttaaaaaagttgaccattcattattgctggaactgaagaaaggaaggatacactggcatcacgatttgtctacataagtccagttcatctcgcgtttgttttggcaagaagaggacactacaaaactcacagtgcagtcaaaacaaaacaaaacaagaaaaaagcacaaaaatggtcggtggggaaccatataacaaaactacatctcaggcagctctttctcaaggaagattctaagattttattatgtggctaattctaaattggaaatggaacatgctggtatgtgaagcaattggtgctaggactttaccctttgctgatatgcaatgataatgtgatgagttttagtgactcttgaattaggataatcacactctttacgtacctcggccgcgcacacgctaatcactagt

SEQ ID NO: 8635 - DNA, 546 bp, Homo sapiens
acaagcttttttttttttttttttttttttttttttttttttgggagggttttgggtttttttttggttttttaaatttcaggaattggtttttttatttaattcattaacctttttttgaaaatatttgaaaaaaaaaatttttttttaaatttttttttttggtggggaaataaaaagttggaggttaggggaaattaagttgaaaaagaaatgggaacatccacccccacctttttggaaaaaaaaaaatgaatgggggggaaaccaagggtagaaggggaacagggggtagggggggcacgggggggggctggctttccacctccttacattttggttacaggggcccaaacccatttggggggctttggaaaaaaaaatggcaaggggttttggagtaaaaaggggggggggggaaaaaattctggatttcgggccctcacaaaaaaggtggtttagggttttcaagctgggaaaaacacattaaaacccgggggacttttggggggtggaggaaaacaaaaaaagggaaaacaacctgga

SEQ ID NO: 8636 - DNA, 290 bp, Homo sapiens
gggtgtgatatcttttttttttgtatatatatgttgtggttatggattatgatatattgtttttaataatggagatagaattgcttgttggattgaaagggagtgtttatttatatttattaagaaatagtataacgatagattgttggttaggttaagattgaatatatatttataaattaatattgagtatattatttgttgtgtttatattatgaattaaataaattgatatgatttattttattatttgaagtcattatattaataagattttattaggtaaaggt

SEQ ID NO: 8637 - DNA, 274 bp, Homo sapiens
ggtactttctatgaaaagggtttggccatatagttgttgttgacgttctgggtgaaaatggaagggttttgtggtccgaataagggggggaaacgataaacagggtttcctcatgaagaagggtgtttggacccttggtcgtgtccgtttgttattgatttgggggcatttctgttccagactaaggaaacttggacaaaaaaagaaaacattagttcgtggttgcatggtggatgtaaatttgactgttttaacctgggttattgtacaaatg

SEQ ID NO: 8638 - DNA, 338 bp, Homo sapiens
gtgccggcaccacatgaaatgggggaccctccgtttgctgttcatcagttgtgcatccttatacagttctgttggtaggatagaacaatgagcagacatctgcacgaggatgacacggctcaagctacatgcatgtgtacggtgatgtgctatgggccacaaaggtaccctatgcgtacatggaactttgattacaactagggcatatttatggctgatttaatgtgataacagtccccagtagtcgcttccgaataaatgaaaagtgctctactgtggggtctggcaagaaaaaagcaaaaatcatgatattcacgctcacatgcaaagaaagtata

SEQ ID NO: 8639 - DNA, 162 bp, Homo sapiens
aaccttttgcttatgctgttttttatttgtttgtttatttctatcatttgttttatataaaaaaaggtggaaagttgaatatatacaaaactaacaagataggaaacctggcaaataatacataatggctctaataatcacataatagcaagctgtcctgag

SEQ ID NO: 8640 - DNA, 194 bp, Homo sapiens
tgcacatgaaacacaagatgagaaagtgtgaagtggagacacagaatagtaagaaggggacaactagagacaagtctgttgaacaagagaaacaacaaaacaattgctgattcatgttgcaacaatatagagggacatcactggggcgagatgccggtgtgataatgtacactagcggtggagccttggcaccg

SEQ ID NO: 8641 - DNA, 322 bp, Homo sapiens
gcacaaaatctagatttgctaggctcgaggtagagaaggacatatgttatagtagatgaaaatgatggaatagcaatgagatacaaaatgcaactaaaaatgggataatctagatattagagaggacttcaaacatgcaaataggaaccacaggtgactatgatggtatatcgatttatgtgtgtgagtattcatggtattacaggctgaatgtaacagacacaagcaaataggttgcctaagactgtgtccttgttctgtcggatgtgggcggggaggatggtcatcttctctggtgtctcactgttagactttgaagcgg

SEQ ID NO: 8642 - DNA, 178 bp, Homo sapiens
gtacaatattggtaattattttatatctgtgaagggtgtgagttaaaaaaaataattcatagaatgacaaaaagtacttaactgttgtgttagctggagtgaaaggtatgatgatatatattaactggaaacagatgaatgtccacggagctttctgttggagaggacattgcagccg

SEQ ID NO: 8643 - DNA, 466 bp, Homo sapiens
gtaccaatacgaccaattgtgtacacatcctgtataggcatgtgcatgggcttgacaatgggacgagtgggtggtaggatgcagtcaaaagcctcaagcatagtggttccaatggaattgtgcatacttaggggtgtactttccatccatatgaactattgcttgtaagcacattggcttccaagatgttgagagcatttaaaacaaagattggcacaagagatactgtgtatgagatagagagaatttttttggtgatagggatggattcatttgcaataagattatgtctataatagcagtttggcggattcaggcgaatccatgatgtaaataccgaccgtggggtcgcaccgaagctagtgtgttggatctaaaggtttgctatatgtggtgaccatcagtgtttaatgccatctacaatatggagcatctctcccttaaaccatctggaacagccacagcc

SEQ ID NO: 8644 - DNA, 258 bp, Homo sapiens
taaattaattagggaaagggttttgaggggggggggtggaagaaaggggttgggtttggtttgtttctcctcccaaaaaaaagccactaaagcagttacagaaatgaagggtaaaatgggggccacaaagccatggtatgtagctttagctcagggaaaaaaagagcgccgggctcacctcattaaccagtatatgcagagatgggcaggggtacctgccgggggcgccgggcggcgggtcgcgctggggccggggct

SEQ ID NO: 8645 - DNA, 178 bp, Homo sapiens
agtactgtttttgttttttgtttgttttttgaagcgagagatgacggtatgggggaaaaatggatgggaaaaggggaacaaaggagagggaggatgcgaggaaaagcaccatccacgcgatgagagaggctattagtgagggacagagtggggacaaaagagagcaaagggaacgtga

SEQ ID NO: 8646 - DNA, 386 bp, Homo sapiens
catttttttttttgttttttttttttttctttctattttttttttttttttttttttttttttttttgactttctttgttttttttgtgatgcttttttttttttttttttatagtaatcaaaatataaaaaaaaaaaaaaggaccggggggaaaaaatctggggaaaaactaaaaaaacgggggggaaaaacaaaaaaaaaaaaaagaaaaataaaagcgggcgagccacaaatggggggggaaaggggaaaaaaaaaaaagaaaaaaaaaaaagtaacaaagggggccccggggagggggggcagaagggaaaaaacacccatcccgggaggggagaggggggaaaaaaaaaaaaaaaaaacaccaaaaaacgcccttcgggca

SEQ ID NO: 8647 - DNA, 450 bp, Homo sapiens
caagctttttttttttttttttttttttttttttttttttttttttttttttttttttttttttttttttttttttttttttttttttttttttaaaaaacggggcattaattaaaaaaaaagggggacaaaagaagggggggggggaagtcacaccaaaactgggggtaaaagaggggggggataaactggaaaaacaaatcaaaaagggggggcaagaacaagaagggagtggggaaattataagtgggaaaaaagccaaagataaaaaaccaccacaaaagggggtccatatgggaaggattcacacatgaggggggtggatcaaggaaagggtcctatccattgaaaaatatatcattgcggccatcatatgaagcgagagcaccctgcaatgaagaatgttaaggggggggtggagagggggaataaaattgggggaatggccac

SEQ ID NO: 8648 - DNA, 394 bp, Homo sapiens
ctattttttttatttttttttttttttcaacatatatacaaaacatcatggtaaaatgtaaaaggaaaatggagtgcgactaggaataatgaataatagaagattataaataaatacgatattaatataaattaattagcggtcataatataatgattcacaacgaaactctggaacatatataatagcctcatgacattactatttaaataaacatgatctgcatccaaactatttaatgcttatttactgcattaccttcggagacagggtctagctctgtcgaccaggctggagagcaggggtgcgatcttggctctgtggaaccgacgcctcccaggcccaagcgatcctcccgcctcacacctcggccgcgaccacgctaatcactagt

SEQ ID NO: 8649 - DNA, 162 bp, Homo sapiens
agtatttttatttttttttttttttataaaaaaaaggacaccacgaaaaaggaagacggcaaaggaacccacacgtaaaacaaacacaaacggcaaaaagaaacaactccctcaaaaacgcggccggaagacaacccaggggggggggagcgaggaaaaaac

SEQ ID NO: 8650 - DNA, 482 bp, Homo sapiens
tttgtttttgttgtttgtttggtttttggggttctaaaaccgggaaggggggtattcttggttccagcaaacgtaaaaagggaagaaaaatgggtaaaagggaacaatgaagctcggagggaagttttccggggggacaaggggggcttaaaggtaaaaaaggtgtctgtaagggatgtcggtgggggaaacgtggcgggggacagaaaaaatgacccaccaagggaagcagggggcttaactgctaaggggataatccggaacaatccaggcaaaataagggcgggttatgcccttgtatggaatggccatagggttaaaatggcatgcaggtttgttgagaggaaggaaaaaatggatggccgtgcgggtaaaaagctggaagatggcccaaatcgttgagagtgtggtgatgttgccatgggggatgtggtgcggtgagagcacatgtgtgtggaaagcctctaatactacgcaacttt

SEQ ID NO: 8651 - DNA, 386 bp, Homo sapiens
gtacttgttttatttgttttggggtatttttataaaacaaaaaacaaaataaaagccttgaaaaataacggggggcaagcaaagcgggaaaaagggggaaaagcacctcccggaggggaacccccgggggcaaggcccagccaaagagacgggacagagacaagaaaccgggaaaaggaaatataaaaaaagggaaagggcgagcccacagaaacccaaaggcggcacaggggggccggggcgggagaacggggacccaggaagccaggaaaaagagggaacaaaaaaaagggagacggaggagggaaaaccagggaaccaccggcggcagcaggcgggggcgaagggggggaggcaaggggagggacagaggaactaaaaaaagg

SEQ ID NO: 8652 - DNA, 159 bp, Homo sapiens
gtacaaatttagtaatttatttgtaaattctgccagaatactttctagctgctttgtaattttttaagagtgttattttgtttttgtttttctgttctttgttgtggctcttgttttcatttttgttgtacctcggccgcgaccacgctaatcactagt

SEQ ID NO: 8653 - DNA, 274 bp, Homo sapiens
ctgatccatcacacatactgcgtggttctgatatagggtgagtttgtcgttgctgctcattgatatgcaataaggaacttaaggaggccttctgacagaagtcactggtcctgttttgtctgaatgagctgcaaaggttgacttgggtggtggcgagaactacatgacacagatgagagtgtgattatgggaaatgccctgaacagttctgagatgctatatatttggaaaggcgtgttggtttgagtgtgggaatatcaaaggacaccaccag

SEQ ID NO: 8654 - DNA, 480 bp, Homo sapiens
gtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgaccctttccttttacctcatttatttggtacctcggccgcgaccacgctaatcactagt

SEQ ID NO: 8655 - DNA, 316 bp, Homo sapiens
gcaccacgagtttgagaaggagatgggagtgtgatggatgccaaacgaatattctagtgctccatcagcttgcgaggatgtacagaaccggggaactgagatactcatatccatgttgggctgtaaaaaggctgtcaaaaccataagatgcacgatggacaatatgctgtgggcctggggacacatactgaaagacggggggaggaggggaaggggagggggcgaatcgttggtagcggggggaaagtggaagacagtgagaagacctaggccgcgacgacgctaatgactagggaattagcgggcgactgggagc

SEQ ID NO: 8656 - DNA, 514 bp, Homo sapiens
gcgtgctcaagctttttctcctttctatgtttttttatgtatttatccttgccgtgtgtagcatgtgactttaaaaaaaaccaacattatccacaagggataggcacatgaagggggagatggtggttgaaaagatgttgacctagaaaataaggcctagcacacagtcactgaaagactattggatagtacagaggggacatgaaagacggaagtgtgtggagaacattgacagaccaaaagttgaagggggaaagaaaaacacaagacggccatgtcaccgaatgttgtggagtggggggggggaggcgctcgggcaacagacaggccatataacagacgatctacagagagggcacagggacagggagcacggtgaagcaggagccagggaggtggaaagcgacatggccgggaatggggagagccaaatattgtgatctacagatagtgcacctctgatggcgagagaccatgcacctgaagctctgtatgtataatggacggcccaaac

SEQ ID NO: 8657 - DNA, 194 bp, Homo sapiens
tacaagcttttttttttttttttttttttttttttggtaatggtctttttattggaaaaaaaaaaaaaaaaaataacatttacaacatgggaaggaagtaaactgtaatttctttgaacaacaatggtggtgggtggggtgaaaaccacaaccccaaaccacttcgccggctccaaatgatgggataaaaaggt

SEQ ID NO: 8658 - DNA, 162 bp, Homo sapiens
ggtactcgtgcgcccggcttcgcttttctccgcacgccgtctgacaaaccggtatggctgatatcgacatattcgataaggtgaaactgaagaaaaacagagacgcaagaaaaaaatacactggcttccaaaaaaacgaatgaacaggagaaacaagcaagc

SEQ ID NO: 8659 - DNA, 242 bp, Homo sapiens
gagtgcaaactttttgcttctattcatctacaatgtatctttccatgtaaatcccatatcttgatgctggggtcctgtgagcagcacacagccagtatcggatagggctgaaaccaaggcgttgatgatgtgcacaccatgtatcgtgtgaaggtgagagactttggtgaaatccgatatcatggtatgatcatccgtgcctccacacacacagatggatccatctggatatacaaccaccg

SEQ ID NO: 8660 - DNA, 290 bp, Homo sapiens
tcatataaaacagcaaaataaaatagtcgtgggcacaggccagtgattctgcagttagagccgtgtggactcggtcccccatctccggtgagggcgtctcctgcacacggcacccatgcttcaggtcgcacacacgtgccgtggacccaagttcacctttggaggtgtcaatccccccaagaagatgttgctaacttggagtttggggcctaggctttcatcagagtcttccccacagaaagcgaaatgggaatgggtccttaataagctacgggcctttgttcacagca

SEQ ID NO: 8661 - DNA, 162 bp, Homo sapiens
ttagaaaggcttgtttagggtttaaaagactggttgttcctgattgtttattggtcccatggtgttttctgtgttaacctgggaaaggcagccttaattacctaaaaaaagaaaaaaaaaaaaaagaaaaattatgtgtgagatttttttttaaagtgggga

SEQ ID NO: 8662 - DNA, 162 bp, Homo sapiens
gactctggggtgatgaatggggagaggagagaaagtgaatcactatatcattctatacataagaatcagtccaggtggattaacaattttaatatgatagagaaaatatatatactttagaagatataggaaaagtatgtgtagtcctctagggtggggaag

SEQ ID NO: 8663 - DNA, 258 bp, Homo sapiens
ggttttaaatttggaaatctaaaatttttttccaacaatcttttgggagggtggacctgggttttttcttttaggttttggtccctctgtttttttattttttttctttttggaattttatttttatttgtttttggttcattttttatggttatataggggggggggtgagagaaataacggagaacgtgggtgagcaagccggtgttaaaagatgggaaaagagtgtggggcaccaaaaaccttgttccctcaagt

SEQ ID NO: 8664 - DNA, 482 bp, Homo sapiens
  misc_feature (1)..(482): n = A, C, T or G
taaaattatactggtggcggtttctgtctatgtgggggatgttctccnttattaccagttacatcctcttcagagctacccgaaaacccctctcaggaaggacaccacgagtggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttaccgagatctgctcagactacatggccttcactatagggttctacagtgtcaggcggttggctacaaggagcttatcggacaatatctgggccagttgggggcagaagatcattggggagcgtgatgaagaaagggtcatgaaaacatctatcagcgtttctggtatcttgtcttcattgatt

SEQ ID NO: 8665 - DNA, 162 bp, Homo sapiens
tgaaaaggatagtggggtgtgggaagggacaaaggaaaggaatatatggtgaggttaaaatgaagaaaaagagtaaggcaaagaaagtattgagatttatattttgatggggatggttgggagggttgaggtgggaattaatttggaaagaaaaatagatgt

SEQ ID NO: 8666 - DNA, 578 bp, Homo sapiens
ataataaaaacaatgaaaataacagtatgtaaataatggtatgtaaaaatctaacaatcacgtgaaattgaagaatttggcatgtaaaatgaataatactgtcttcccccaagaagtttagcaccaaactggctctggtgctgagataaggaattccaggccaggcttacatcgcaactcagtcctcaaaagccctctcgtgcagaatgagaaggcacaagcatatatacccattttgttttcaccttccatctctctcaatcaaatcttacttctcattttaggaagtatatagtccaaaatgggcttttaattactctttgatccttccaccccaccctgcccttttctttcctagcaaggaaatgacaatgagtgtggcctatagacaagggtaattacagatacaccagtgggctgtgtcgcccaggataaggggggagagctcaaagctggtcagtgtgtgtgctcctctctccacttagctgtcattccaccctgtgcttttctacttccctcttacaaggggcaacaggggcgggggagccccacggcacgtccaaggcataggttaatga

SEQ ID NO: 8667 - DNA, 162 bp, Homo sapiens
  misc_feature (1)..(162): n = A, C, T or G
gcccagctctgggaactgaattangaaactcaaatcgaatagggaagcaaaaaaaacaaaacaaaaaaaacaaaaaaaaacaaaaaaaaaaaaccctattttaaatggaaagggagcttaaaaaaaatttttttaagggagggaagaaagggagaaaatttt

SEQ ID NO: 8668 - DNA, 162 bp, Homo sapiens
actttgtgatatctcatagggcatactggtctttcaccatttcgcccccactttttgcccatatttcccaagctccccccctacagcaccttccatgtgctcgtgccttcatccagcacctgctccccaatgtattccgtggtagcaggtgatgtaacacac

SEQ ID NO: 8669 - DNA, 210 bp, Homo sapiens
gtatagagagggagaggtttttttgttttatagtagagagggggtttcaaaggtgttaaggaggatggtttagatataatgaaatagtgatttggaatagtaggaatacataagtgatgggaattaaggggatgaggtggagaagtatgagaaggattattatttttaatagaaaaaagaaaaggaagagaaaagaggtgaggtgtgagg

SEQ ID NO: 8670 - DNA, 562 bp, Homo sapiens
gagcggccgcccttttttttttttttttttttttttttttttttttggcgtttcaccttatttatttatgtatttattgagacggagtttcccctcttgtcgcccaggctggagtgcagtggcacaatctcggctcactgccacctccgcctgacaggttcaagcgattctcctccctcagcctcccaaggagctgggattacagctgcaagatacaaaccctgtcctcacttacgtacaattcatctctgacatgaagcagtctcccggggctccgcgtctgttcgctctgggattaaattcgcgtaggcactggggaggcgggagctgccttcgcagatatttagcatatgaggatcgaaggccagtgggaaccgtgaggagacgcacaaccgtggtttgggcccaggggcctggggggattgcgagggggggtcagctgccaagaaggccaaaaatagccggacgggtggggggggaggcgggcaaggagaagaagctgggcaatggcggctggtagttctgggtgcttcctccggtcccttcaaccccacctccaccg

SEQ ID NO: 8671 - DNA, 226 bp, Homo sapiens
cggccgccctttttttttttttttttttttttttttttttttttttttttttttttttttttttttttttttttttttttttttttttttttttttaaaaaaaaaaggctttaattttttataatggattcaagccaacaaaggtgttcaaaaaaaattcaaaaaggaaaaaaggtcaaaatttaaaaataggggggaaattttcagtttgaaagggtaaaaggat

SEQ ID NO: 8672 - DNA, 226 bp, Homo sapiens
cctttttttgtttttttttttaaggatatgtttttattgctaccagagggttttatcttcagtatacatgcgttgactggcaatacctgtgttcagactgcagagggagctcaggatgcagaagtcatgttaagaaacataaggctggggagggggggggagtaagttctattagaaaatgccaatagcttaacaaacctgagggtattacattcagttataccat

SEQ ID NO: 8673 - DNA, 338 bp, Homo sapiens
agcttttttttttttttttttttttttttggattttattttaaagttttattaagaaaaaaaaaaaaattaaatggggtattcatggttttggaaaaagagaaaaaaaagggaaggggaacaatcccataagggaacattattctttgggttaaataatattaattatggaaatgaaaactaataacataacaagggaaattaaaaaaaataaattaagaaaaaggaaaagagaaggggaaaaggattctgaatatgggagaaatgtgtgttatggaaaaagattcggggttcagggtaatttcctggagaatttctggctttgaagcggttaagtca

SEQ ID NO: 8674 - DNA, 258 bp, Homo sapiens
gaaggaacagatggactcatacactccacgatgtaagctggactagtccaacttccaacgtccgtataacgccatatgtatcttattgctgtatatagtggcaaatagaatagacaacaagtgagaggtacgactaataggggagaaaaggaacacatatgtgataggtgatgagctctgacatctgatgaaataggtgacgaacttctaccatgaacaaaatgtgttgccccacttcagataggttcatcatcttag

SEQ ID NO: 8675 - DNA, 242 bp, Homo sapiens
tgattgtggagttattcaatatataaaaagggatattcgagatgacttgaatgagctgtcttattattcgtgtactgagatgaatgttcaacgcataagtagtatatgagttcatacaagtgatggctgaagtgctgtcagcagctaatatggtgagcgaaaaggagtcagatggtgtttcgaggtcgaagagcatccgagttaatggtggtcctgcgcgccagattcgaattggaaatatc

SEQ ID NO: 8676 - DNA, 418 bp, Homo sapiens
gggtcctgacgcccaggatgggagtttctgtgaaggcactttcagataaacattaatattttaatttgattcaaaaaggaaaatggaggggctataaacctgatttttttaattaatttattttaaaaagtcaccagggataataagttcggacagttacggaaatatttttaccatacaaaataaaaagataattcaaaaaatttcttatgggaattgacgtccagaatttaggtccatgttcactagctaacccacttagtagggtggggcgagcacaaactctaccttcccatttctaggcctgttcctccctccttaaggggggaataaatattaacagggtggtggtgaggtttaattgagataaagatttatctactaaaataactcagtgatactttatggttatagtcaa

SEQ ID NO: 8677 - DNA, 258 bp, Homo sapiens
gtacgggccaggctcctaatctttgggattcattggcaaataatttaagtgtggtgtattattaaatagacaaaaggtaagttgcaaggttgaaggatcacttgataagtgagactggtgatgaacattgatgcgcttaaaagtgaagatgcttacagaataaatgaagagcagctgtccttctttcctccttctagatgttcatgctgtggcatgctcagaggttcctgcatggataggagatgggagcggagtgat

SEQ ID NO: 8678 - DNA, 226 bp, Homo sapiens
ggttcgggggggaggaggtaatcccttcatatttcaatgttttctttttgcttattttttgtattctggtgtatggcgtaagtacagataatgcttcatctcgaatggtcgtttttatataatttttttttttctcttatcatcatgattcatttaacaaaatgtttcaagcttactcaggtatgctatagtgtactacagatgaatgttgggttaaatatagagg

SEQ ID NO: 8679 - DNA, 194 bp, Homo sapiens
agctttttttttttttttttttttttttttctttttaagttttctttttaaaacacacaaaattcaatttttttttccttttttttgcaacagaaaaaaagaattgaaattggacctcccccttagggaaactttttcttttggttaacttattttaattattgaaaataacacttatataaataacagggaca

SEQ ID NO: 8680 - DNA, 162 bp, Homo sapiens
cttcgttttgctttctcttcctttcttcgtacaacaccatgtatatgcaggtgaaagagatgaccaagactagtaggctgaattagaaatttatgctgactctatctaataataattatgttggtttatgtttatctctattaaatagtgcttttggggaat

SEQ ID NO: 8681 - DNA, 162 bp, Homo sapiens
gtgtacgcaggagtccctgcgttgttcagctcctgtgcttgctgtatttttgcactttctcacagacctatatcatcaaacgctcataactactgtgctattgagtggtaactttgctgatagggctgctcaattcatgtatgatggagataatgctcacgg

SEQ ID NO: 8682 - DNA, 210 bp, Homo sapiens
aaatatgaatgttaatatataaagataaagtattgggaaaaagaattataattaaatgtcacatataaaatggattgatgggaagaaatgagaaacagggtaaagtataaaatggaagtggatcaagaataaaaaaaagagaattatgaacaaaaaaggaaagaaatatatagtcgggattacaagaaagaaatgaagtcaaataaaaaa

SEQ ID NO: 8683 - DNA, 194 bp, Homo sapiens
gattatggaaattgaagttatttaggggtttttaaattaagggaagtggaggtattttttttagggaaaaagaatattaattaaaaaaatagttggtttttgtgtatttaaaaagaattaaaaaggaatggttataattaatattttatggttagaaaaggtttagtgttgggtttttataaataaagtgtgga

SEQ ID NO: 8684 - DNA, 162 bp, Homo sapiens
ataagaggataaaaaacttcgaaagtaaagacacagaaatgacgaagctgaaggctgagagtctcccttctcacttactccatgctttatttagcattccctaaacggtgaggaggcagcggctgttatggtgtgggacaaaaccagccaccgggagatgat

SEQ ID NO: 8685 - DNA, 226 bp, Homo sapiens
gtctctgttagaggatgtgactgtgtggatggactatatatagagaagatgggtgtctagagcttagtgctaagagcctatgcgcgcaagagatatctcaaattcatagttagatgaaatgcgaggaatgtgctgctatgattgacaagaggagtagaaatgatgtactcatcctcttctacacgacataatgcaaaataggatgacatagattgtgggaatggat

SEQ ID NO: 8686 - DNA, 546 bp, Homo sapiens
tattattatcgcactcgagtctaagaggctgcactcaaagcaataagctgtgtcaacggtgtccgaggagggtaatagttgatcagaggacattgaaaatgaatcttgctgcttcatggtatattaatatctgaatagtcagacaactgtaatattatggaataaacacatcgtcaaatatatcattaatatcataaggataggtacacatggaacgttatgtacctcggacgatactgactgttatcactattgtatccggagacgtgtgcgcgtcgaccatatctgagagcgcggacggtgtaggatgcatatgtagactatgctatattgtcgtctacatagttggacatattcatggtcatagctgtcttctgtgtgatattgttatctgttcactatatcactcgacatacgagtcgtaatcatagagtgctgtgtgtgaggtgtctactgagtgagctaactcacatatatggcgtggcgctctctgctggcttgcctgtcgtgactcctgatctgagccagctgcattaatgagtcgtc

SEQ ID NO: 8687 - DNA, 562 bp, Homo sapiens
tggccagattacgaagcgcaatgttgagattgagaatttgtctatagagagtacatattcgttcagcaccatgatcactctcatcaacgatgtttattgagaggatggttgtccaccttatacaggctcatggacctataataacgctttccaattctacacatacgtgtagacgaggtagtctatatactcagaacatctagcctgctctgtatctacagtgcatgagtaagtatatgtatatgtatgacatagaattccatatcgaagaggtcgtgcaagtacactggtgctgatgctgtggtgctcgaggaatatcggctgctaatacacgtatatctattgaattgtatcagatgatatgtcacatcagttgtgatcatcactgtcgtaggaatgttagatagaatattatatgtcatctctctatgactaggcttgtactcctggtgcataggatactgctgtgtgtggtagctgtccgtgcggacgctcgacatcactagagaatgcacggatagagtgtaagtcgagcagatggtagagatctgagcgcagtgag

SEQ ID NO: 8688 - DNA, 402 bp, Homo sapiens
tggggagctatggagtctggtatggtctttgagattccctgcttgagctgggaagggggtgggttctcgctaggtttaattgtactgcaacgtatcagagcaggcgccactagtcttagagagccagagcgtcatctgttgtagccactcggctcagacgtggttgtgtggaagcgactgtggatgacacacaaagtgtgcagtgttgtgttcctatgtaactttatttatggatcttgaattttgaatatatactgtacctgaccgggcggccgttcgacatgactactgaattcgctggggagtgtaggtcgactatatgtgagagttagaaacgcgttggatgaataatcgagtgtgtgatagtgatggctatataccgtggagtactcatggtagtag

SEQ ID NO: 8689 - DNA, 194 bp, Homo sapiens
aagctttttttttttttttttttttttttttttttaagtttttaaactttttatttgcatattaaaaaaatagggcattgcaataattaaaatcgtttgaacaaaaaaaaaaatgggactctgattaaactgcattacagcctggaggacaccttgggccagctgggcgttaaccaagatttcacgggccgccc

SEQ ID NO: 8690 - DNA, 194 bp, Homo sapiens
ggctgcgggacgtgatagacgattaaggtatgattgaataattatactgatatagtgtgtaagatctcttagagagagctgtgtaattattcatctatatatttttactaactaacgtgaaagaaaggatgctggatgagcttgttctgagagtatctacttgaggctgggatgatactccaagggttgatgag

SEQ ID NO: 8691 - DNA, 162 bp, Homo sapiens
gcgggccgaggatatcatgactagatttatatgtaatatttattattagggaaagttaagaaggaacagaagactagaaaagaagtaaaaactttgatgaagagaggggtgtaagaacaggatcaagacacattaatgcctaataccaacaacgagcagtgg

SEQ ID NO: 8692 - DNA, 226 bp, Homo sapiens
aaagaagatacaagctgacctgaataaaatttgtgcaggaggcgaagaaaataagggtataattatttggagaccatgggaacacgcaaacattatgcagaaatctatgttgtggataaaagtataaatgattatgatgttaaaaaaatggggattgaacataaaggacaagtgtgtgtgatgaaccacagaggaagtaaaagcttaagccatgaaattactaaaa

SEQ ID NO: 8693 - DNA, 194 bp, Homo sapiens
  misc_feature (1)..(194): n = A, C, T or G
ccgcgggccaggctactaaggtgcaagtatatgtaaattgttttgatacctttanagtgaagggagccttttgagaaaagttggtggagtgcatcgtatcataaagcgggtaggtagtacatgtaggcagtaaatattatttaaaaatgtggatagtatactgtgaagttggttggtctagaaataccagtttc

SEQ ID NO: 8694 - DNA, 242 bp, Homo sapiens
cacctgccgattgcctatgcccatgtgcctgcccttccgggggaacaaggggtcggtgggggatgacggcgatggaacggacgcacagaacgctagccgatgatcataacatcgttgatgagaaaaatgatatgcatgacaggagtagaggttggcgattgtattaggatcattgagatcaaaccacatcacccatgtgccacactgccacgactcataaagggtgttggtatgtggatggt

SEQ ID NO: 8695 - DNA, 402 bp, Homo sapiens
ccatgctatttgattttcctcatttcaactgttttgtatgaaaatcttaatacctatgtatatggtcctaactataggccgcacatttcttttataattcctgttggagagagaggggagggaaatttatgtgaatacctggtgaccttccttgactttccaggtttcctgatgtcattcattgattatgttctccttcattatttttatactaacttaaaaattgagtatttggagaaggttttatagtatttattgatgaatatatttagcatatcaaaatttttggttttaaaaactgagtaatattaaagactataagcaaacaaaatttatagaaccggtcattaagtaattgcttaaaacatggagcccattactctaacctttataaaaattaac

SEQ ID NO: 8696 - DNA, 274 bp, Homo sapiens
gagtacaagcttttttttttttttttttttttttgtattttattttaaagtattattatgaaaacacacaaaatcaaagagttatccatggatttgcaacagcagagaaacagtgacaagagagaccatcacccataagggggaacacttatccctttggcgttaacttaatataaaataattgggaaatgatcaccctaaatatcaatagacacgggcacataaaaaaaaagattaaaattaaagaaaaagggaccaggaaactggcgggaga

SEQ ID NO: 8697 - DNA, 770 bp, Homo sapiens
ggttttttttttttttttttttttttggttttgaacctttaataaaagtaaaaaatgaatgcaaaaagaacacaatgttgaaaacttagtatgaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcactcgctgctttcatctaataacttctgggttttcataaaatgctgacatcttcattggaaatttttttcatgtaactggtttcattttcagaaaatatataagggggtcattccaaagttcagaatgatcctatttttttaaaaaacaaaattcctgtaaaacaaattaactccaggaacttaaaatttactccaagacatttccctcaaaacaaagcaaaaaaccccagcaaagatcggtacatcacaaaaacaaacacaaagaccagcgctcacaggcaagttcctcttagcttccattctgctgactgggggcttccatttaaaaagaggcttttaatcaagccactttcacagaatttaaaacaaaacaaacacatgttaattgcaaaaaacaaaaaaggaaaattattagaaaaaaagaacaaaacccaaaaaacg

SEQ ID NO: 8698 - DNA, 178 bp, Homo sapiens
tagcctcagcggggaccctcagcacatgaatacttcctcattcctggccccctcccttggcccttctgcctctcttcactgccatacaattgtgtgaaggatgtagggaagtggaaggaattaaataaagaaggaaccagcggtgaaggcccccccgccccccacagactaggtcggc

SEQ ID NO: 8699 - DNA, 178 bp, Homo sapiens
aacactatgcattacatacacacaaacacacaccacagtcataaagccctaatgatgtgctgattacaggtcaatattcaggtgagcattctttattaatttatcaaatgaaaagctttttgctacctctgccattcatgaaagacagctatggaaaaaaggaacctggtaccaatat

SEQ ID NO: 8700 - DNA, 370 bp, Homo sapiens
tggctggactgcagtacagcggataaaacagggaaacgtaaaaagtaatcagatgactgttatcgagatggagagcataccagtaaaggtagcactgactgcaatatttgtaatataaatctaaagtttatatgttaatgaatatcaatatatatatggggtatatataattacactaatcagtgacagaagcacttataatagcgacttctgagtaatgaagaagagaaatgatgaatatatgtattatctatagggcctatatacggtgactgcctcactatgatcctatgggttgtgagtaattatgcaaggctgtgtgaatgcacagctgtatctgaaggggcaactacgcagtgctgcctaagca

SEQ ID NO: 8701 - DNA, 209 bp, Homo sapiens
gcccggaggatgagcatgagcataaaggaagtgtggtaggacagatcaaagggaagtacatggaatgtacgaggtttttcaattaggaatcaaaaaagaaacgaggagacttcgaaaagctgactaattattagggaactgacttggatgctgtaagcaaagctatacatgatctgatacaagagatgggcggactggcgttagcatgt

SEQ ID NO: 8702 - DNA, 322 bp, Homo sapiens
tgattacaaagctgtatgtcatgggccaactatgcaataaacctaaactagagctatgggctgtgagtggatttcacttgatgataccatgaagactgatttatgatgtgatactatccattcttctgtcggtatgaagttatgcatgacaaaatgatggagtgcttaaatgggatgtcatatggacaaagaccgtgtgaagtgaccctgatgatagcatatcatttcaggataactaatgactggcaggttgcaaggattgttgacgactgggactggacatgcgcggataggtgattgctcacggacatgctcgagaaaa

SEQ ID NO: 8703 - DNA, 578 bp, Homo sapiens
atcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactggtggcttatgcagcactggggaggagaggggggcccgg

SEQ ID NO: 8704 - DNA, 354 bp, Homo sapiens
aactggtgctgaagataatgacatcagcaaccgagactaaggcaatacgtcattgacaccaatacaatgagcctgtgtgtgatgggtctgttcgtgctagtgctcgattttggattttgatctctatcagtatcattgggcttggactctgacactgccagcggctgctgttacactgatagggagaggaatcggactggggaggtagaggacaatgacaacgagaacatcagctcctgctcacaggcggctgtggtaagcaaagaaggccacgctgtacgcactgtaccctgcgagcagggagtcctgcaggggcggcctgggcggtctactcatgaatctgaggtcgattgt

SEQ ID NO: 8705 - DNA, 226 bp, Homo sapiens
tggtattggtaataaaattttgatctctaagaagattaaaagaagtagggaagcgtgatgttagaagcgatggcgattttctggtaagcggtctatggtctgttttattataaactaggaaaagaacataacagctcacaggacccaacttattgatgaaatgaactggagtgctgacagatactagggatagaaatagatgaagaagggacggaaacaattacta

SEQ ID NO: 8706 - DNA, 498 bp, Homo sapiens
agcatacacggcagatatgcaccatgcaatgcccgagtgaagcactgcctgaggacaaagagggcttgaatgtcaggagtgtgtgatggaaggatggacggcgcggctgcgaagatgctgacagatggacagacccaccagaggaatgaggaggctgcaatggtcaagagagtatccggaacgatccagggcgaagaaacgccggctatgcatctgcattggagtggcacaggggtcacattgcatgcgagagacggtgagcgtggggagaaataagatcgccgtactggaaagatgctggaagagggccggaaaccatggaagtctggtgaggctgcaatggtagatgtggatcatggctagtccatgtgagctgagtagttaatcagactaggcacatcggggtcgcaactgctgtgcgtgatatgacacagacagttgctgtgggcgtactgaatgatgaggacaaagaagcggatggccctgataaagaaagga

SEQ ID NO: 8707 - DNA, 226 bp, Homo sapiens
tgtacacgggggtgtcttgcgcatgtccatcgggaggtagggggactgggtggtagcgcgagttatacacgatgaaggcgaactggacacgttaatgtgcttggaccccatgccgatcgcgacatacgggctagctggaggagggaaacggcgatgatggggcaggatgaaggggcaaaaataggggcgtggtgagcagaaaataactgctggccttattttatgt

SEQ ID NO: 8708 - DNA, 498 bp, Homo sapiens
ttttttttttttttttttttttttttttttgggtttgaacctttaataaaagtaaaaaatgaatggaaaaagaacacaatggtgaaaacttagtatgaatgtgaacctcactagatgttcaaatctggtagagtgcaaattttggtcatactattttacatttttacaaactcaaatcactttgggtcatatattttctataaactattggcaaaaaaatcctcaaatttacattcttttggctacattatttctaacagatatagatttacttccggtttcggagagaaagacttattgtgtgtgcgtgatcaagtctggtttaaagattcactcgctgctttcatctaataacttctggtttttcataaaatgctgacatgttcaatggaaatttttgtcaaggaactggtttcattttcagaaaatatataaagggggcaatccaaagttcagaaagatgctattgttttaaaaaacaaaaatcctgtaaaaaca

SEQ ID NO: 8709 - DNA, 162 bp, Homo sapiens
  misc_feature (1)..(162): n = A, C, T or G
cgagagatgacgttccaagacatctgagcancccgcggggctatacaaccatgtaaccaaagcctcaccccttcccgcagttggaaaaaaatttatggaacaagaaaagttatcatttgaaatttaaaagggtgggcagaacattggtcccaaggaaatatt

SEQ ID NO: 8710 - DNA, 194 bp, Homo sapiens
  misc_feature (1)..(194): n = A, C, T or G
tgaagactagataggagtggnaagactggacgtatgctctgaaggagcataggagacataagtaaaagcgggcagtaaactgtcgtctgatgattatgagaccatgggaaaaagcatgagacaggtaaaacatagtaatgggcatgttacaagccactgacgtatgcctgcactattgtacagcacctttcacc

SEQ ID NO: 8711 - DNA, 162 bp, Homo sapiens
tctttttgttttatttatgttgtattgtaagatgtcaaagagtaatacgcaaggcacaaaagatcatattgttagcttgtatggttgacagagacagtgaatattatcaaggaaacatcacatctgaaggacttagcattgcaacacacaatttataagaac

SEQ ID NO: 8712 - DNA, 210 bp, Homo sapiens
gctggtgtgttatttatttgtggtacatttagaggaaagaacggtagggagccatatatgacgaagagggtaagaaggcacatgtagtaagaagaataacaagtgacacgccacagtgggtcagtggcgcaagataacgcgagatcattaactgacatggtaacaatctggtacatatcactgtgtatacatggagagaaactgacgtga

SEQ ID NO: 8713 - DNA, 178 bp, Homo sapiens
cggttgtgctgttatttttatttttgtgtattttaagaatgcaaatatctgttaaagcgagcaatatatgatcaaagaaggcgaacgaatggtaggggcaggaggtagaatcaacaaggaccactgccacttggggatcagtggcgcaaggtaacggagctagattaacctgatatgg

SEQ ID NO: 8714 - DNA, 194 bp, Homo sapiens
ggtgggcgtttatttctttaatgttaggtttaagaggaaagtagctgggatagaaggcatgcataatacagaaggctatgaatgctatggcaagaagaagggataatacgtgcgcgtgccacatgggtgttaggggtagaagataaccgtgagcagaactgtatggtatagttggtccatagtctgcttattag

SEQ ID NO: 8715 - DNA, 514 bp, Homo sapiens
caagcccccgccgcacccacctccacccccccccaaaaggaaaaacaacaaggaagaacgtacccaggcagggccaccacaaaaggggagcatcaaccgagcccacgagcgggcaaagggaaacgagcggggcggggggagacggacagggcgccagacacaccaccagcagagcacagcagacgggccgaagccgggcccgggggccggcctggacacgccccccgggcgcaggaccccccgcccatgcccccgaccccgcccgccacccacgcggccggcggaccagcacagacccccaggccacggcggggaacaaaaccagcacaacccccgaggaggcagacccacaccaccgcccccaaggagcccccccggcaggcgccggccccgaccccgccaaccggcagcccgcgggcagcgaggctccaacaggcccccccacgcgacacccaccccctacaccccccaccaagcacgcagcgaaaaaacacacgccaagggagggcaagcc

SEQ ID NO: 8716 - DNA, 306 bp, Homo sapiens
ccctttctttttttttttttttttttttttttttttttttttttttttttttttttttttttaaaataaaattaaaaaccaatgaaatttattgggttacagggaataaccgggcacaaaatggtggaaaaaggggttaaaacaagtttacattaaaaatacaaacaactacggggggtgacaaatttggaagcggggggtacttaaaaaaacggcatcgaaaaacaaaccactaaaaattcgcgaaatcaaaaaaataacttctttcttctttaaaaaaggagggggaagaagtcgttgggttat

SEQ ID NO: 8717 - DNA, 194 bp, Homo sapiens
aggtaacaaggctcttttttttttcttttttttttttttttttttacccgtttaaaaataacattttttattatttccccaggcccgatccacagccctgaaacaaaagcattctgatacacatttgtcagtgctggggggtttggttgccatgactgcctacacaggcgcgatgaacagccaccccgggttgg

SEQ ID NO: 8718 - DNA, 242 bp, Homo sapiens
tgggcaaactgactggtgatggcaagagtggtgtctatgaagacggactacacagcatggcacatacaataaacactgcgagactctatgcgattacctggctactacacacatttatacccaacataacttcatgaattgatgccaccatgtgcaataaactgcgccgtctggtgctcagaggaacaccaggcgctgcaacctgcagctctatcaggacgcccagactccgccattagggg

SEQ ID NO: 8719 - DNA, 466 bp, Homo sapiens
tgctatcacaaatattctacttgtaactattcaactgcatcgctgacataacatggttgaacgattgggataatggcactaagcactaggtgtagatatgattatgactataatacatgggtaaaggtgctgataataaaacaaactctaccatactagatacactgagtcaatgtatatataatgtgggatacgataatgaactcacaactaatatggcagggacacatatatgaaacacaatatatcctgtatttgcgatataagcatcattataagatcataagtagattgtgcgaagaatcctatgtatgccggactgttttatcctgacccaacccatatgacttgtcccagtggatccgggagaagagatatgaatgacatgtagccggactgagcctacacagttacacccccgatatgaagggaacgaaaatacatcttattgcataagctccagcag

SEQ ID NO: 8720 - DNA, 450 bp, Homo sapiens
tttttttttttttttttttttttttttttttttttttttttttttttttttttttttttttttttttttttttttatttaaaagttttattataaaaacacagggaataaaggggggaatccaggttttgggaacagaaaaaaaaaagggaaaggggaccctccccataggggacacttatccttggggtaaactaaaaaaaaaaagggaaaaaacaccaaaaacaaaaaaaaagaccaaaaaaaaaataaatttaaaaaaaaaaacaggaacggggggagggagaccggggtaggggggaaaagggggcaagggaaaaacatcaaggctaggggggcctcccctgaaaaattgcgggcttggggaagtcaaggtcggtggcagggacaaacccgtgcccggcccgcgggggggaggggaggggaagggggggggggggcggggtgaggg

SEQ ID NO: 8721 - DNA, 210 bp, Homo sapiens
tgcaaatgaatgaaaatggtttaaaatagacacaagacatgggccaacatacgttctactgacgatgcagaggaactgggaccctacccagctggactgggaatgggaggggtgccgccatgctggaaagtggcgcgggagtggcttaggatgccaagtacatccttaccatgacatacaccaacgccactgatgagatgtgcacgaagg

SEQ ID NO: 8722 - DNA, 354 bp, Homo sapiens
acaagctttttttttttttttttttttttttttgctcacatttaatttttattttgattttttttaatggtgcacaacacaatatttatttcatttggttcttttatttcattttatttgtttggtgctggtggtttatttatttttactgaaagtgagagggaacttttgggggcttttttcctttttctgtaggccggcttaagctttctaaatttggaacatctaagcaagctgaaggggaaaggggggttcgcaaaaacactcgggggaagggaaagggggctttgttaatcatgccctatggggggtgagtaactggttgggccctgccgggggcgcgggggggggcgg

SEQ ID NO: 8723 - DNA, 162 bp, Homo sapiens
gttggccccgtaggttactagtctagtgtcttcagtatgtaactactgtgacctcatgctggtcaagggtctaagtttaactagcaactatgtattccagtaaaatcagatgtaaagtatactactttggtactaggtacctaagtaggtcactttcacttg

SEQ ID NO: 8724 - DNA, 354 bp, Homo sapiens
gctgcagtgacatgagacagaacagcgcggagggcgccacaaaagcagcggacaagaaagccgcaggagcaggcaaggccaccaagccagcccagaaagcccagaaggccaaacgaacaccaccccaaacaccagccaccccacacacaaacagcggaggaagaacggtctcagaaccgcaagcatcaaccggccatacaagaagagcagcaaaagacaggacaacgacaacaacgcatcgcaaaacccccagaaggaaaggagaacgccgcgaggaccaccccggcaaccccactcgcgtgcggcagcataaagccacaagtaaccaaaaccagtacgctgccgggactgcaa

SEQ ID NO: 8725 - DNA, 578 bp, Homo sapiens
ctggtctttgtgtatggttttgtgatgtaacgatctttgctggggttttttgctttgttgtgagggaaatgtcttggagtaaatgttaagttcctggagttaatgtgttttacaggaattttgttttttaaaaaaataggatcattctgaactttggaatgacccccttatatatgatctgaaaatgaaaacagttacatgaaaaaaatatccaatgaagatgtcagcattttatgaaaaaccaaaagttattagatgaaagcagcgagtgaatctttaaaacagacttgatcacgcacacacaataagtctttctctccgaaaccggaagtgaatctatatctggtagaaataatgtagccaaaagaatgtataattgaggatttttttgccaatagtttatagaaaatatatgaaccaaagtgatatgagtttgtaaaaatgtaaaatagtatgaacaaaatttgcactctaccacatttgaacatctagtgaggggcacattcatactaaggtgtgaacaatgtgtgtctttttgcactcattttttacgttttattaaaagagcaaaaaacaaa

SEQ ID NO: 8726 - DNA, 498 bp, Homo sapiens
  misc_feature (1)..(498): n = A, C, T or G
ctgatattgtgtagacgaaaagatgatctgcaagatgataaagatctggaatatggccataaactgtagaanggtggtgaagctgtcattgctgatgatgctgccgtcgagcacatgggtgctgacgagcccatatactatgcaaccttgtgacactatgcagcttcggatatgatacatacacgtgatgtgagagacacaaaagcagtggacgagatagcagcagggagacggcaaggctgccggatctggccaggacaccaagaatgctcaaagaacattatacgctatacgaatcacatcactaataaccaccggcggaataacagtcacaggagtgagaactgcaatagaacagttaggttcaataggccaatacaggttaatgataacaaagcgtcgtatgaccacaatacagaaaagaaaatgcataatgaaacgataatgttttgtggaccacgtgtggtagctttaatgcatgaggcagtaatatcagat

SEQ ID NO: 8727 - DNA, 162 bp, Homo sapiens
aatgctcaacgcattacattacatgaactcacccatgtgatggtagtaactgttcttcatcactaaaacatggaagcgaaaaatgagtcagatgctgtttcgaggctcgaacaccatcccagcaatggtagccctgcctgcaatcttcgactttaataccca

SEQ ID NO: 8728 - DNA, 258 bp, Homo sapiens
gtagagtaggacagagacaagaaaaatataatgcacacacacattggatggttgtacttgcaaactagctaataacactagggaagaacaaaggatccaaaagcaggtggagagcataaaagaacacatgaatgggaagtcctgcaagagctacatgaatatacgagatgactctataaaagctgactaatcattatgtatatgactggaatgatcaacacacagaactacatgaaactcatccattgtaggctgatc

SEQ ID NO: 8729 - DNA, 194 bp, Homo sapiens
atggatgttaattgaataatgatggtaaaagggtagattattggttgtattttgattgatgttataatgaggaggtttgtggataggagtgaataaagtgattggatgagtgggcgaaatattatgagttgatgatgggatatatggaggatggggataagtggagaggagaagatgggaaagtggagggaaaa

SEQ ID NO: 8730 - DNA, 402 bp, Homo sapiens
gtgcaccgagacgcgcggaggcagaggctcgggtgcgtgcaagacacaactacaccggtagcaccaccgacatgagccgaagaaggcatcgtgactggacgtgtaagggaggtaaacactgcgtccacaagaggatgtgaaaactgcactaaaacacagatggcacgaccacgtgaaataagatatgatgacggacacttatacaagcgacaatggcaactccgtgtactagcatcgaagtgaggaagagacgtatgtatgaacaagacagtgctggtaggacggactgagactgaacagacactatcatactatctccaagggcgatgacgacaagaaacagggagaatgagatatgacttagttaactggacagaagggggaaaacaagtatatggtcgg

SEQ ID NO: 8731 - DNA, 498 bp, Homo sapiens
  misc_feature (1)..(498): n = A, C, G or T
tacactaaatacaaagtgacaagggtgtctgtgtgctatgctcactacaacaaacccttcacctaaaaaacaaatggaagaaaaagagaaacagctgcaaatagttaaaagcactatagtaacacataacaaaatgtgagagatgagagaatagaaagagtagaaaatataactacttgctgtgaacctatggtagttacgctctgtcagtctgtagcatacataccataccatataaacacagcacaagagtaagacaacaacacatggtgaagctagactatgtgcaggatacatgatgcgtgataacatctgcaacatgagacaaacgtagaagagaactgaggcaataaataaaagtgatacctatagacggatacagtgatataacgttgggacactgggtggaagcgcgggataggagcggtatgtgcatcactgctgagcacactaatatgaatgtagtaaatggaccacgtccagggtagatgactgnag

SEQ ID NO: 8732 - DNA, 178 bp, Homo sapiens
ctgtagtttaagatgttagacaccagactctcacgcttgatccaaacatctttactcaaccacacaacaaatgaggtaatatctgtgtgtaagtttcaccttttgtcatttaccttctcctctcggtaaaaatgtaaagaaaaaagtgtatatgcttctccttgctccactgtaaata

SEQ ID NO: 8733 - DNA, 210 bp, Homo sapiens
tgttatattagtgatagatatctattatagattgtgaatcaaaattatgaatcttcagattgatgtggttgtcgtgaatatggttcagaagatgtcgataagtagtaggactgcaagtttaggttacttatgctaggactgatgtttgtttgaatatttgtaagtgcttggttattgaaagtgattgcctttaatccaagacttatagtg

SEQ ID NO: 8734 - DNA, 338 bp, Homo sapiens
aggtactttatgaatatgccagaaatatgttacataagcaattataagacgtgcaagtatggaatggattacctcgtctccgctcaaaaacactgatctctgaaggaagatggatttatatgtggatatgcaagtctgatcataaggttcattgtgagatgatggggaacatgtaacttagttatagagctaagaggagttattgtgcagtgtggagtactcaagctttcttatctagatgtactcagtcatctggctacctcggtgcgtgaaccaatctaattattaatggattagcggccgtctggaggtcgatcatataggagaagtccgtgcgc

SEQ ID NO: 8735 - DNA, 210 bp, Homo sapiens
ggcccgggggcaaggtacctaattttggctttcatggatttacatttttttaagggggcgtttaaggtgaatttattgttatttaataatgtcctggagataactttggggtataagattccaattttaatgtaattacctactattatttttgtgttgtcgttttgcaaagaaagataatgattcctgggggcttggggaaatattaat

SEQ ID NO: 8736 - DNA, 258 bp, Homo sapiens
tacagctttttttttttttttttttttttttggttttaagttttattattgaaaaaacaaaaattcaatggtttattcatgtttttggcaaaagaaaaaaacaggggacgggggaccttcccctaagggaaaattattctttgggttaaattatattaattatgggaattgaaacttattaaattaaccgggaaattaaaaagaattaattaagaaaaagggaaaggaacgggggggaaggggtcttgatttgtggga

SEQ ID NO: 8737 - DNA, 370 bp, Homo sapiens
gtatacgtgtattatttgtttttgttttgttctgtgggaatgaagaaatattttagtaaagtgtggggagcgggatgatgttcaatctcacaacttttggaaatgcttcttggtgctgtcagccgttggtgatctttatcttatttaaatgcactgtattgtgcagaggtctggtctcgcgtgttgtgaccattatttatatctggatatccctaagataggtggacaggtgtgcgtgtggtggcggtcgctctatctctgttgtggattatacgtcggatgcagatgagatatatgggtgtgctcataatgcgttggatgcataacatgagtattatataatgtaaacaaaatagcttggggtcggtat

SEQ ID NO: 8738 - DNA, 386 bp, Homo sapiens
actgcacactgatctgtaactcatcgcatgttgttattttgttttatcttcataccaggtcatattatctttatgaacagactggtgtatctactaaaaaatatatttatttctgagagctatgtttttggctgggaggagtgatatctcttcatacttaaatgttttattatatgcttaattattgtattctgggtgtttggttgtatgtacttgctgcgaggtggtgctgagatgtcactactgggtgcgccgctgcatgtcagtcgaacatatgggagagcttgcaagtcgtcggttggatagctctactattctatagtgtgaatataatagctgtctataatcgtggtcttaattgtttgctgttgtgatattgttttcct

SEQ ID NO: 8739 - DNA, 258 bp, Homo sapiens
tggcgcctcgggtagtgatccatgagaaagccatgtcagttcgaacgatagatcgttaagactcatgagagaaactgacgagtttaatctgaatctcctagttctttggagatggagatgaatcgtgaatacagctgagatctagtagatattattaggtagcaaatgaaattgtagttggtggtggttggaatgctataataatctttgttctccgtgtctcagttgaaatctttacacaaattataaggctgggtg

SEQ ID NO: 8740 - DNA, 386 bp, Homo sapiens
aggtaggagcattgtgcccattatttcttatggtcgatagagggttcagggggtgctaatacggtatataccggccgtatcttcatgatggctaaggaaagttatttgaggaatatcgagcatgaacgtgtgttttgttggggagatactgtaccattgagtgtattttactgacgcggctgtgttctgatgaaagtggttgggtatttacgtcttggaaaagtgtttgtctttcaatctgatgtgttgccagctcatatgtgcgaggtgttgtgctatgtgttcattatcagaatgggggtttccatatgccatatctgacgtggtggcctgtctatatcaatgaatgtgtcgcagctgaatgacacgttgaaaatattggagag

SEQ ID NO: 8741 - DNA, 386 bp, Homo sapiens
aaatgtttgatctgttattgaattgatctgtacagagtcatgatatttttttggtatgtatgagtaacatgaatgcttctgtatgaaacagttgttatatatactctagatttatatactaacattctggtttggctatttatgtgatattgatggtgttatatattatagtattatgtgttcattccataaattttatgaatataaattcattgatttctgtcttctatggtgatggtgggtgactagtgtttggatggagtctaatattaaatgattgtagcgattgattatgtatggaattaatatctatctcatataagacgcaaaaaaaacaaggaaagaataataccaaatgtagtggaggaagagggagggaacgaaag

SEQ ID NO: 8742 - DNA, 322 bp, Homo sapiens
gtacaagcttttttttttttttttttttttttggtttaaaatttttttattaaaaaaaaaaaaattcaatttttttatcaatttttttgcaacatataaaaatcatggacgttgaaccatcccaatagggaaatcttttctttgggttaaattattttaattatgggaaatgatatttattacaataacaaggaatttaaaaaaatataattaaaaaaaagggataggaattggggaaaggattctttattttggaggaattgtgtctcttgtaaaagcatccgggttcaggcaaccttccttgaaaatttcttgtttctaa

SEQ ID NO: 8743 - DNA, 386 bp, Homo sapiens
taggtatcgtgtgtggcgctgacgtcctcctctgaagcatgggatctctgatttgctaggtcctggttgcttcagttgcctgattagtctccgaggccgtgttagcagtcagtagatgtccgtactagatcctgtgaggtagggtggtgggtactgggagatgagtagatagagatgccagtaacatgttgtcttcctaaacaagagaggtcgggaggtatgtgtgtgggggaagtgaggagtgggtccagaaatatgtcagagagctggtgttgagtgactgatgggtataaagatgtaggtgtaagactcagggtgtcagtggggaggagcacgagcctgagctcgtggggagcatgacgtgatgatcgtcgtaggagacgtta

SEQ ID NO: 8744 - DNA, 594 bp, Homo sapiens
ggtactgattttggatttttgattttttttttgggtgtgaacttatacttgattgatatatatcatatatagataatttgaacatatgatttactatccattgtgggttgatgtatagattgtcaacttatatttggaatgtaataagtatgtattcttctgttaatgctatgttctcctggtgttcatctgacacatggaatttgtgtctgatgtgccattagagcggtgtctcatattgtccgcatatcttgatcgaggtagtgaattggatcgtatcttttgatttataagtgttcattgtatgattctgtgagttatacataccacggatgggatgttgcttatgttggctgcctatttggtctgtgagattgagcgtttttatcacatacatttgcctaatttgtcataatacaatggattagatgacacctctgtcgcgaacattcttatctgtattgtattcgtggtggacttcacgtcgaatatgtgggagatctcctatcgcgatgagatgtgtagcttgatgttgctatagcggtccctaaatggctcgacgtcatcattatcatggttgtttccagggtgtag

SEQ ID NO: 8745 - DNA, 514 bp, Homo sapiens
gcaggtactgattatggagtcaatgaatatatggaagggtcattcatgatatatgatgtaggatggtatgttttcatatggatcaacgtagaatcattcaagttatgtatggtatgctgtgtatacaatggctcatatagtgagatgatatctataaatgtatatgctgaataatattactttatgtttttatgtacattgtttgattaggtgaaataagtacataacgcatgggatcttgcgtaggtcggctgtctagatggactctgacataaagtcttgttttcggatagcatagattgattagtggcatctaataggattatctgagacagtcaggggatataggattcataaatcatacttgtatctagtcatatgcatgcttatctacacaaaagtagatattatatatacttatctgattgatgagatctctcatatctctcccatatttattatgttgtatatcaatttatggatttttatctggaatttgaagatagcacgttcg

SEQ ID NO: 8746 - DNA, 306 bp, Homo sapiens
agtgattatggaaacatgaagctatttaagggtttattacccctaaaggaatggaaagtaatctataatatggataaaagacatttattaaaaaaaataattgttgtctgtgtatagaaaagcagcttacaatgaatatgttatcaataaatatctatgcttagaaagtgcaaccttcttggtcttataaacaaaaagtgggcattggttatcctttgataacttacggccagggggttcattaggaaatccaccccatcatgatggaagtttggcggccccatcttccgttatggttaaaaaaaa

SEQ ID NO: 8747 - DNA, 430 bp, Homo sapiens
aggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccaatgcagcatatttttcatagaatatgcattgacccatggcttgtggatcaccgaacatgtccaatgtgtaaacttgatgtcatcaaagccctaggatatgggggagagcctggggatgtacctcggccggcgacacgctaatgactagt

SEQ ID NO: 8748 - DNA, 178 bp, Homo sapiens
cagtcagtttacgagtgtttctagattaggttgtataatttatgatggattggcagaggtgcatacattaaatgtaacttgttttttgtcctctcccattatacataatggagtgatgatatactgaatgtgtgggaagaataatgaaagagattgaatttctacatctagtgcatca

SEQ ID NO: 8749 - DNA, 194 bp, Homo sapiens
tactaataatggtgttggcttagctatgatggattcaacatgaaaaatgtgaagctgtgataggtcattgtaatgtaaaatttgttaagacaacaacatcagtttttgggcggatatgatatttattgtgtaaatttgctgatggaggacaggaccagagacagaatcagcaatatacatgctatagggaagga

SEQ ID NO: 8750 - DNA, 402 bp, Homo sapiens
aggtgcatgctggatgataggatgaatttgaatgaatggtatctcctgagaatgggcagacactagaacatgaccttctggacttacagactggcgatgtgaatacaaaataatgtgtcgagatgtgatcgacaatggtattccactgaggggtactacagtcagacaagatatgacgaagatgtgtgagggagtggggaggaagatgagaaagtagtggtattatccgaacacagtagaattggtgcaatttgctgatatgaaatggtggatacatgctagattcaagtgtgatgagaattggtactagggatggaaagtcactgctaagattgcaagtgagtgagagtggtgagccagatgctctggactgcgtcataacatggacttgtgcaaatgata

SEQ ID NO: 8751 - DNA, 162 bp, Homo sapiens
cagaattatataatactaatgcgtatgtgatgtgagacggtagctgctgtcagacggcatcactgtgaattcagatgcaaagaggaactgttgatcttgatgcccatacctctgatcagaatcttgacatactgtcatgagacactatagggtacgttatca

SEQ ID NO: 8752 - DNA, 194 bp, Homo sapiens
agataactatgggttaaaagagagagtggattttttatacatgattggatacagtgggattgaccatcagctgactaggagataatataacaggctgttgaaagtgattgttttttgaagatagaggatatgagattttctgctgatcttataatggtgtgatgtctgatatcttgtgttcgctgttattgtta

SEQ ID NO: 8753 - DNA, 162 bp, Homo sapiens
acacactgccactggcttttgctgtccacggccatgacagaccgacgcagcgagctttctctcaaaagcaatgcttaaattttattcataatatactgactgcaacaacatcatgaaaatacaaaaaaaaaaaaaaaaaagacttgtacatgaacagaggcg

SEQ ID NO: 8754 - DNA, 466 bp, Homo sapiens
ggtcatacaaagagggcactacaccagcttcttggcctcaaagaagctcttgaggtgacgcatctgccagatgccagtgaggatgaggatgacagtctgagcaatggaccaccataggtacctctggttggtgctctcgctcgtcagtcggaagcgctcttcacgatacctttggtaatcctgctccttctgaatctgttccacctgatcaagcaactggcgggagcggagctgtagctccgacagattatcttttgaagaaatctcagggtagtagtaggaatgctccccaaactggatgtagagatgacaccgaagtttgacaacagagaagagagccatcctgatagaataggagtgaagacagatatgatggtcaccgggagtgtgggaggtgaaagtgaagaggaactcagagcagataatgaccgggaggaagaacgaaataaatagagaataagaagac

SEQ ID NO: 8755 - DNA, 496 bp, Homo sapiens
gagtgagcctcctcacccctctctgctctgctgatgggggcttttggacagcaaggcatagagcagaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtgtggagatcatccaggttgagagggagaagagtggattaaagacagtcagtgggattaagtgtctaccctgaccttgcttctctacatttccttttcatcttgaaagaagttggaggtggcaaaaatattaagaaggtggatcagaatgacttggggactgaaatttgtgagggaagagacaggctgtgcaccttctagaatggatttatctcttttatgactaccaagaaggga

SEQ ID NO: 8756 - DNA, 258 bp, Homo sapiens
cataggtgcttactatactgttttgtttctgaatttggaatttctcaaaattaaaaaaatatctactgaggagcttttcgttttaactggtggggaatgggttctgggtggttttgccccttgtttttttagattcaagaaatccatggtgaaaggtttggtattctatgaagaataggaggataaagtgatcaaggagatggcagctcagatgcgcgaggtggagcagagccgacaggaagtgggcgtgtccgctct

SEQ ID NO: 8757 - DNA, 551 bp, Homo sapiens
  misc_feature (1)..(551): n = A, C, T or G
aggtacacattgccatgagatggcactttctgaggatactcactaaaactgagtttcttcattagaaaaatctcactttttatcatcatctcagtgcctggtattggtgcccttangtctgtgaacagcattgcgttatgccagtaaatgaatacttaaatcaataattgcattctcagcagtcctcttagtctttgtttgtttgtttgtttttcacagttgaattgcaatgtagctgtttggcagaggcattaacatttttgccctaaccctggcctggtgcctangctcaggggagtaaaattagagccaggagccagngagctgaggagaccacttaaaaggcatgctagcatttgataagtaaggggttactttgtgaggaaaagaaactttatatgctttaagcaagcctctttatgaggaagaaaaggtcagctactgaagcggggtcccaactactgctgggtctgtagaggagagagacacccccaaaatccagatgttttagttaacaatcagacacagacttgtctctggtttcttacagg

SEQ ID NO: 8758 - DNA, 466 bp, Homo sapiens
  misc_feature (1)..(466): n = A, C, T or G
cgggncagnntacatggntgnantggagncctnncctccacccctctctggctctgnctgnnatgggggncttttggnacagccaaggncataggancaggaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtggggagaatatccaggttgagagggagaaaaatggattaaaggacaagcagggggattaaatgtttaacctgaccttggttgtgtatattttgttttgaattagaaagaaattggtggtgggaaaaatattaggaagggtgaacagaaagacatgggggcaggcatatgt

SEQ ID NO: 8759 - DNA, 450 bp, Homo sapiens
tgatttctaaagtaagcctcagaatttccaaaccaattcatccacagctgtttctgggctggttttaaagtagctgctacagaatcatgaggctttccctttttatcaaatacgaaaaacatttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctgggggctcactttctcccaggattgtgggcttctctggaagtgaagggtgaggaatgagtggggtgtcgagcccagccctggctgcctgtgggtttgggggagggagcgagggatgaggtgccctggcagatggca

SEQ ID NO: 8760 - DNA, 530 bp, Homo sapiens
gcagcttccccgagctgatgccattcgttcacgtctcatcgatactttctctctcatcgagcatttgcaaggcttgagccaagctgtgctgcgacacactatcaggagttacttgatccttcccgccagaagaaacttatgttgggagatcaacaccagctagtgggcgtctctataaagcctcaacgtatagaacagatttcacatgcccagaggctgttgagcaggcttcatgtgcgctgcagtcagaggccacctctttctttgtgggccggatgggtccttgagtgtatcctttcatgtcactcatttttatcctggctgttgatcatctgcctaatgaattattttttgcttcccaaactccattgtctcattctcaatgcttatgttattgctcttattatttccgctgcataaatcagaaagaactcaaaaaaaaaaaaaaaaaaaaaattggggggcggaagcttattccctttagtgaaggttaattaaagcttgggactggccggaggtgtacaaagtcg

SEQ ID NO: 8761 - DNA, 690 bp, Homo sapiens
  misc_feature (1)..(690): n = A, C, T or G
taagcgtgtccagaattggtgggtctcactgacttcaagaatgaagccgcggaccctcctggcggaattctccacgagttttgagcagcctcggttttcccaccacctccaaatcatgcaagacacagggtaagagcaaagacaatgtggctgtggccgatgtccaccctctcggggcgtcccttctcttctctcctccttgagcagggagaccatcggggtgcaacctggttggggcggggaggaggtgcagggcctggccagagcgggcctggccacgggcaagggacagcgacccccgggccaggacaggtgagagcggcgcaggcccgggcccggcgtggcggaggtgcgcgtgagcggncagcagagggcgccagagagccaggagcggcccgcagaggagcccgcgccggccccggtgcccacctccgcgccgcgcggaccctccgagcccgcgctcagacgccccagctccgccgagagggcgcttgcgccgggtccttctcccccaaatgcaggcagagcccccggagccatgggcaggccttccggcagctccaaagccactggcaagccccgaaggcaggatggccggcccaggagggaggaggacgacgtcccctcccgaagagaagaagctgcggctcttgctggtaggggggaagcgcacagccccaggaactggaa

SEQ ID NO: 8762 - DNA, 418 bp, Homo sapiens
atagattttcaaaatgtctaaaaagtgcagtttgaattgttacatgttaatacacagttgctttattcagatgtgtttgtgttgacggactaacagtgccttctggatctgtgcaaataatggtacccctccctgcaaagaaaaaaagagtcattaaagcactacaatattacacataaactgatccatctaggtcagctttagtcaggaccggagaatcagcaaacataagaaaaacaaaacctaggaatacatacaaaagctctcatggggtgctagaaccctcttagactggtgatgtatgtggagggcattaagagctggaaaggcgtatatgggtaactaccgttaactatattctacagcaagggctgggggggcagaacaaggtgaaggtgggtggttattagggttggga

SEQ ID NO: 8763 - DNA, 632 bp, Homo sapiens
aatgaatgaaaataaagttttacctcccaagtcaatttcacataattctaattccttttaactagagaatatcttgtttagaaggatcattaagctaggtcaaggtaaaaaacaggttataagacaaatgcatatgaaatctacaacttataaggaaagaaaataccaaattagttctatcagtcctctaaactacagaagaacattatttttacctagtgtgcatgtacacacacacacacacacacacacacaaatatttaatgcttttaagtacatttttaaaaaaaatctaaacaatactttgactagtcttttcctcctaatattatatatagactgaagtttttgaaaataaaagtagctgagccaatgaaatgctttagcattgtatttttaccatcaagcactgtttagcaggctgtatttcccacttttcttcattgatatcaggagcaagcactagaaatatagaaaataaatataaaataatcacaagttcttaaccttatttttttcagtctttatcagcttcacgtagagagctgctcactgtgttatagcactttttaagttgcaaagccttgtcatatacattataatttgtattcctctaagcaagtcaaggggcg

SEQ ID NO: 8764 - DNA, 450 bp, Homo sapiens
tgcagacctcggaagggagcggatagcggcacccggagccgcccgcagagcaaagcgcggggaaccaaggagacgctcctggcactgcagataacttgtctgcatttcaagaacaaactaccagagaccttacctgttcacttggctctcccaaccaatggagatggctccaatggtggcacaaaccagggaagggaaatctgaggtttaattcctttatgcctcattctctgagtgctgaaggcttgctgtaggcctgtatgcctgttaaatgctaaattgtgataggggtttttgccttccaatgaactcccacatatttacattttaccagtgtatgatgccctgttactagcattgacatgggaacaaaattgctgccggggggaggatgaacaaagaaagtcatgaagttaccccttgtctgggataaaactatagtactttcaa

SEQ ID NO: 8765 - DNA, 562 bp, Homo sapiens
  misc_feature (1)..(562): n = A, C, T or G
ggggtaccattttacacacctccgncggtggnaaatccttgnaaagnaaagcagcaccagctgctgactgcaggcctctctgccacctctgcctgcccgcctcactgactgcttcatctgccagcctcgcatgcacttctgacaacacacctgtccatcacagacactgccagctgctctgtgtgtatccatgtgtgtgagccagtggtgctggcgggcagcggaacgatcgtccgtgatgctagaccgaacatgcacgggcacgcatctcctggcgtgtgagtggaggctgtcagaggggcggacgggagtgagggcatgtgtctgcatgggactgatagggacagagaaacagtggcagacttgggcgatacatagctcaccagacaaacatgcaccgtcagatagatagagggtagaaagatcagggagaagagagagcccagcaaacatgcacaccangcagtggcgggagaggcacgctcactacataggaagaatgaacagacggcacacgcacgcagggcatggactgcagcacatctaaccaaccatgcctaga

SEQ ID NO: 8766 - DNA, 594 bp, Homo sapiens
  misc_feature (1)..(594): n = A, C, G or T
cattgccatgagatggcactttctgaggatactcactaaaactgagtttcttcattagaaaaatctcactttttatcatcatctcagtgcctggtattggtgcccttangtctgtgaacagcattgcgttatgccagtaaatgaatacttaaatcaataattgcattctcagcagtcctcttagtctttgtttgtttgtttgtttttcacagttgaattgcaatgtagctgtttggcagaggcattaacatttttgccctaaccctggcctggtgcctangctcnagggagtaaaattagagccaggagccaggangctgaggagaccacttaaaaggcatgctagcatttgataagtaaggggttactttgtgaggaaaagaaacttttatatgctttangcaagcctctttatgangaagaaaaagtcagctactgaacggggtcccaactactgctgggtttgtagaggagagagacacccccataatccagaggttcagttaacaatcagacacagacttgtctctggtttcttacagggtgacagcagtattcgctattttgagatcaccgatgaaaaccccggcaccc

SEQ ID NO: 8767 - DNA, 754 bp, Homo sapiens
  misc_feature (1)..(754): n = A , C, T or G
actatatttaggcaccactgccataaactaccaaaaaaaaaatgtaattcctagaagctgtgaagaatagtagtgtagctaagcacggtgtgtggacagtgggacatctgccacctgcagtaggtctctgcactcccaaaagcaaattacattggcttgaacttcagtatgcccggttccaccctccagaaacttttgtgttctttgtatagaatttaggaacttctgagggccacaaatacacacattaaaaaaggtagaatttttgaagataagattcttctaaaaaagcttcccaatgcttgagtagaaagtatcagtagaggtatcaagggaggagagactaggtgaccactaaactccttcagactcttaaaattacgattcttttctcaaaggggaagaacgtcagtgcagcgatcccttcacctttagctaaagaattggactgtgctgctcaaaataaagatcagttggaggtangatgtccaagactgaaggtaaaggactagtgcaaactgaaagtgatggggaaacagacctacgtatggaagccatgtagtgttcttcacaggctgctgttgactgaaattcctatcctcaaattactctagactgaagctgcttcccttcagtgagcagcctctccttccaagattctggaaagcacacctgactccaaacaaagacttagagccctgtgtcagtgctgctgctgcttttaccagattctctaaccttccgggtagaagag

SEQ ID NO: 8768 - protein, 730 aa, Homo sapiens [sequence omitted]

SEQ ID NO: 8769 - DNA, 674 bp, Homo sapiens
  misc_feature (201)..(201): n = A, C, G or T
  misc_feature (477)..(538): masked repetitive sequence
taaaagcaggctgtgcactagggacctagtgaccttactagaaaaaactcaaattctctgagccacaagtcctcatgggcaaaatgtagataccaccacctaaccctgccaatttcctatcattgtgactatcaaattaaaccacaggcaggaagttgccttgaaaactttttatagtgtatattactgttcacatagatnagcaattaactttacatatacccgtttttaaaagatcagtcctgtgattaaaagtctggctgccctaattcacttcgattatacattaggttaaagccatataaaagaggcactacgtcttcggagagatgaatggatattacaagcagtaatgttggctttggaatatacacataatgtccacttgacctcatctatttgacacaaaatgtaaactaaattatgagcatcattagataccttggccttttcaaatcacacagggtcctagatctnnnnnnnnnnnnnnnnnnnnnnnnnnnnnnnnnnnnnnnnnnnnnnnnnnnnnnnnnnnnnnactttgggattcctatatctttgtcagctgtcaacttcagtgttttcaggttaaattctatccatagtcatcccaatatacctgctttagatgatacaaccttcaaaagatccgctcttcctcgtaaaaagtggag

SEQ ID NO: 8770 - DNA, 1010 bp, Homo sapiens
  misc_feature (1)..(1010): n = A, C, T or G
cggacaggtacctaaaagcaggctgtgcactagggacctagtgaccttactagaaaaaactcaaattctctgagccacaagtcctcatgggcaaaatgtagataccaccacctaaccctgccaatttcctatcattgtgactatcaaattaaaccacaggcaggaagttgccttgaaaactttttatagtgtatattactgttcacatagatnagcaattaactttacatatacccgtttttaaaagatcagtcctgtgattaaaagtctggctgccctaattcacttcgattatacattaggttaaagccatataaaagaggcactacgtcttcggagagatgaatggatattacaagcagtaattttggctttggaatatacacataatgtccacttgacctcatctatttgacacaaaatgtaaactaaattatgagcatcattagataccttgggccttttcaaatcacacagggtcctagatctgnnnnnnnnnnnnnnnnnnnnnnnnnnnnnnnnnnnnnnnnnnnnnnnnnnnnnnnnnnnnnactttggattcttatatctttgtcagctgtcaacttcagtgttttcaggntaaattctatccatagtcatcccaatatacctgctttagatgatacaaacttcaaaagatccggctctccctcgtaaaacgtggaggacagacatcaagggggttttctgagtaaagaaaggcaaccgctcggcaaaaactcaccctggcacaacaggancgaatatatacagacgctgattgagcgttttgctccatcttcacttctgttaaatgaagacattgatatctaaaatgctatgagtctaactttgtaaaattaaaatagatttgtagttatttttcaaaatgaaatcgaaaagatacaagttttgaaggcagtctctttttccaccctgcccctctagtgtgttttacacacttctctggccactccaacagggaagctggtccagggccattatacagg

SEQ ID NO: 8771 - DNA, 21 bp, Human cytomegalovirus
atgtggccgcttctgaaaaac

SEQ ID NO: 8772 - DNA, 19 bp, Human cytomegalovirus
tcatggggtggggacgggg

SEQ ID NO: 8773 - DNA, 20 bp, Human cytomegalovirus
gtacgcgctgctgggtcatg

SEQ ID NO: 8774 - DNA, 21 bp, Human cytomegalovirus
tcataccccgctgaggttatg

SEQ ID NO: 8775 - DNA, 20 bp, Human cytomegalovirus
cacggacgacgacgctgacg

SEQ ID NO: 8776 - DNA, 21 bp, Human cytomegalovirus
gtacggcagaaaagccggctc

SEQ ID NO: 8777 - DNA, 22 bp, Human cytomegalovirus
caccaaagacacgtcgttacag

SEQ ID NO: 8778 - DNA, 22 bp, Human cytomegalovirus
tcagacgttctcttcttcgtcg

SEQ ID NO: 8779 - DNA, 21 bp, Human cytomegalovirus
cagcggcgctcaacatttcac

SEQ ID NO: 8780 - DNA, 22 bp, Human cytomegalovirus
tcagcatgtcttgagcatgcgg

SEQ ID NO: 8781 - DNA, 21 bp, Human cytomegalovirus
cctccccaactactactaccg

SEQ ID NO: 8782 - DNA, 23 bp, Human cytomegalovirus
ttactcgagcttattgagcgcag

SEQ ID NO: 8783 - DNA, 20 bp, Human cytomegalovirus
cacgtcgggcgttatgacac

SEQ ID NO: 8784 - DNA, 21 bp, Human cytomegalovirus
tcaacctcggtgctttttggg

SEQ ID NO: 8785 - DNA, 20 bp, Human cytomegalovirus
ctgtctgctcattctggcgg

SEQ ID NO: 8786 - DNA, 21 bp, Human cytomegalovirus
ttactcggggaacagttggcg

SEQ ID NO: 8787 - DNA, 20 bp, Human cytomegalovirus
atgatgaccgaccgcacgga

SEQ ID NO: 8788 - DNA, 21 bp, Human cytomegalovirus
tcacggtggctcgatacactg

SEQ ID NO: 8789 - DNA, 23 bp, Human cytomegalovirus
aagcttccttacagcataactgt

SEQ ID NO: 8790 - DNA, 27 bp, Human cytomegalovirus
ccttataacatgtattttgaaaaattg

SEQ ID NO: 8791 - DNA, 21 bp, Human cytomegalovirus
atgatacacgactaccactgg

SEQ ID NO: 8792 - DNA, 22 bp, Human cytomegalovirus
ttacgagcaagagttcatcacg

SEQ ID NO: 8793 - DNA, 19 bp, Human cytomegalovirus
ctgcgtgtcctcgctgggt

SEQ ID NO: 8794 - DNA, 21 bp, Human cytomegalovirus
tcacgagtccactcggaaagc

SEQ ID NO: 8795 - DNA, 20 bp, Human cytomegalovirus
ctcgtcttcttcggctccac

SEQ ID NO: 8796 - DNA, 22 bp, Human cytomegalovirus
ttaatcgtcgaaaaacgccgcg

SEQ ID NO: 8797 - DNA, 21 bp, Human cytomegalovirus
gatgcttgtaacgaaggcgtc

SEQ ID NO: 8798 - DNA, 22 bp, Human cytomegalovirus
ttactgagacttgttcctcagg

SEQ ID NO: 8799 - DNA, 21 bp, Human cytomegalovirus
gtagcctacactttggccacc

SEQ ID NO: 8800 - DNA, 22 bp, Human cytomegalovirus
ttactggtcagccttgcttcta

SEQ ID NO: 8801 - DNA, 18 bp, Human cytomegalovirus
acgtccctggtagacggg

SEQ ID NO: 8802 - DNA, 24 bp, Human cytomegalovirus
ttataagaaaagaagcacaagctc

SEQ ID NO: 8803 - DNA, 28 bp, Human cytomegalovirus
atgtattgttttctttttttacagaaag

SEQ ID NO: 8804 - DNA, 27 bp, Human cytomegalovirus
ttatattattatcaaaacgaaaaacag

SEQ ID NO: 8805 - DNA, 22 bp, Human cytomegalovirus
cttctcctttccttaatctcgg

SEQ ID NO: 8806 - DNA, 20 bp, Human cytomegalovirus
ctatacggagatcgcggtcc

SEQ ID NO: 8807 - DNA, 22 bp, Human cytomegalovirus
atgcatacatacacgcgtgcat

SEQ ID NO: 8808 - DNA, 22 bp, Human cytomegalovirus
ctaccatataaaaacgcagggg

SEQ ID NO: 8809 - DNA, 20 bp, Human cytomegalovirus
atgaaagcaagaggcagccg

SEQ ID NO: 8810 - DNA, 23 bp, Human cytomegalovirus
tcataaggtaacgatgctacttt

SEQ ID NO: 8811 - DNA, 21 bp, Human cytomegalovirus
atggactggcgatttacggtt

SEQ ID NO: 8812 - DNA, 22 bp, Human cytomegalovirus
ctacattgtgccatttctcagt

SEQ ID NO: 8813 - DNA, 23 bp, Human cytomegalovirus
atgaacaatctctggaaagcctg

SEQ ID NO: 8814 - DNA, 22 bp, Human cytomegalovirus
tcagcacacgaaaaaccgcatc

SEQ ID NO: 8815 - DNA, 21 bp, Human cytomegalovirus
atgaagccggtgttggtgctc

SEQ ID NO: 8816 - DNA, 22 bp, Human cytomegalovirus
ttaaataaatcgcagacgggcg

SEQ ID NO: 8817 - DNA, 22 bp, Human cytomegalovirus
atggatctcttgattcgtctcg

SEQ ID NO: 8818 - DNA, 22 bp, Human cytomegalovirus
tcaggagccacaacgtcgaatc

SEQ ID NO: 8819 - DNA, 20 bp, Human cytomegalovirus
cgcaaaacgctactggctcc

SEQ ID NO: 8820 - DNA, 22 bp, Human cytomegalovirus
tcaccactggtccgaaaacatc

SEQ ID NO: 8821 - DNA, 20 bp, Human cytomegalovirus
tacggctggtccgtcatcgt

SEQ ID NO: 8822 - DNA, 22 bp, Human cytomegalovirus
ttacaacaagctgaggagactc

SEQ ID NO: 8823 - DNA, 26 bp, Human cytomegalovirus
atgaccacctctacaaataatcaaac

SEQ ID NO: 8824 - DNA, 22 bp, Human cytomegalovirus
gtagaaacaagcgttgagtccc

SEQ ID NO: 8825 - DNA, 19 bp, Human cytomegalovirus
cgttgcggtgtctcagtcg

SEQ ID NO: 8826 - DNA, 21 bp, Human cytomegalovirus
tcatgctgtggtaccaggata

SEQ ID NO: 8827 - DNA, 5252 bp, Homo sapiens
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctggatccatgggcatacctgtgttcgaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttggttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggaactctgtgtatgaatcctgattttaactgctaggattcagctaaatttctgagctttatgatctgtggaaatttggaatgaaatcgaattcattttgtacatacatagtatattaaaactatataatagttcatagaaatgttcagtaatgaaaaaatatatccaatcagagccatcccgaaaaaaaaaaaaaaa

SEQ ID NO: 8828 - DNA, 5252 bp, Homo sapiens
  misc_feature (3967)..(3988): Masked repetitive sequence from Repeat Masker
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacnnnnnnnnnnnnnnnnnnnnnngtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctggatccatgggcatacctgtgttcgaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttggttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggaactctgtgtatgaatcctgattttaactgctaggattcagctaaatttctgagctttatgatctgtggaaatttggaatgaaatcgaattcattttgtacatacatagtatattaaaactatataatagttcatagaaatgttcagtaatgaaaaaatatatccaatcagagccatcccgaaaaaaaaaaaaaaa

SEQ ID NO: 8829 - DNA, 841 bp, Homo sapiens
ttttttttttttttcttaaatagcatttattttctctcaaaaagcctattatgtactaacaagtgttcctctaaattagaaaggcatcactactaaaattttatacatattttttatataagagaaggaatattgggttacaatctgaatttctctttatgatttctcttaaagtatagaacagctattaaaatgactaatattgctaaaatgaaggctactaaatttccccaagaatttcggtggaatgcccaaaaatggtgttaagatatgcagaagggcccatttcaagcaaagcaatctctccaccccttcataaaagatttaagctaaaaaaaaaaaaaaaagaagaaaatccaacagctgaagacattgggctatttataaatcttctcccagtcccccagacagcctcacatgggggctgtaaacagctaactaaaatatctttgagactcttatgtccacacccactgacacaaggagagctgtaaccacagtgaaactagactttgctttcctttagcaagtatgtgcctatgatagtaaactggagtaaatgtaacagtaataaaacaaattttttttaaaaataaaaattatacctttttctccaacaaacggtaaagaccacgtgaagacatccataaaattaggcaaccagtaaagatgtggagaaccagtaaactgtcgaaattcatcacattattttcatactttaatacagcagctttaattattggagaacatcaaagtaattaggtgccgaaaaacattgttattaatgaagggaacccctgacgtttgaccttttctgtaccatctatagccctggacttga

SEQ ID NO: 8830 - DNA, 841 bp, Homo sapiens
  misc_feature (94)..(121): Masked repetitive sequence
  misc_feature (569)..(604): Masked repetitive sequence
ttttttttttttttcttaaatagcatttattttctctcaaaaagcctattatgtactaacaagtgttcctctaaattagaaaggcatcactacnnnnnnnnnnnnnnnnnnnnnnnnnnnngagaaggaatattgggttacaatctgaatttctctttatgatttctcttaaagtatagaacagctattaaaatgactaatattgctaaaatgaaggctactaaatttccccaagaatttcggtggaatgcccaaaaatggtgttaagatatgcagaagggcccatttcaagcaaagcaatctctccaccccttcataaaagatttaagctaaaaaaaaaaaaaaaagaagaaaatccaacagctgaagacattgggctatttataaatcttctcccagtcccccagacagcctcacatgggggctgtaaacagctaactaaaatatctttgagactcttatgtccacacccactgacacaaggagagctgtaaccacagtgaaactagactttgctttcctttagcaagtatgtgcctatgatagtaaactggagtaaatgtaacagnnnnnnnnnnnnnnnnnnnnnnnnnnnnnnnnnnnncctttttctccaacaaacggtaaagaccacgtgaagacatccataaaattaggcaaccagtaaagatgtggagaaccagtaaactgtcgaaattcatcacattattttcatactttaatacagcagctttaattattggagaacatcaaagtaattaggtgccgaaaaacattgttattaatgaagggaacccctgacgtttgaccttttctgtaccatctatagccctggacttga

SEQ ID NO: 8831 - DNA, 63 bp, Artificial Sequence
  T7T24 Primer
ggccagtgaattgtaatacgactcactatagggaggcggtttttttttttttttttttttttt

SEQ ID NO: 8832 - DNA, 1010 bp, Homo sapiens; identical to SEQ ID NO: 8770
  misc_feature (213)..(213): n = A, C, G or T
  misc_feature (491)..(551): masked repetitive sequence
  misc_feature (601)..(601): n = A, C, G or T
  misc_feature (761)..(761): n = A, C, G or T

SEQ ID NO: 8833 - DNA, 20 bp, Artificial Sequence
  Primer
acagaactggcctccctgtg

SEQ ID NO: 8834 - DNA, 21 bp, Artificial Sequence
  Primer
aaacagaaaccagggcacaca

SEQ ID NO: 8835 - DNA, 20 bp, Artificial Sequence
  Primer
tttggcgagtgaatgggttt

SEQ ID NO: 8836 - DNA, 20 bp, Artificial Sequence
  Primer
cacagggaggccagttctgt

SEQ ID NO: 8837 - DNA, 20 bp, Artificial Sequence
  Primer
agctgccttctgctctccag

SEQ ID NO: 8838 - DNA, 20 bp, Artificial Sequence
  Primer
tgcagcctcacctctgagaa

SEQ ID NO: 8839 - DNA, 20 bp, Artificial Sequence
  Primer
gaagcttcctcgcggtgtaa

SEQ ID NO: 8840 - DNA, 20 bp, Artificial Sequence
  Primer
agagcgctggagagcagaag

SEQ ID NO: 8841 - DNA, 20 bp, Artificial Sequence
  Primer
ccctggcctctgctcaacta

SEQ ID NO: 8842 - DNA, 20 bp, Artificial Sequence
  Primer
aattgttggagagcccctca

SEQ ID NO: 8843 - DNA, 20 bp, Artificial Sequence
  Primer
agtgcatgtttgggacagca

SEQ ID NO: 8844 - DNA, 19 bp, Artificial Sequence
  Primer
ttgggctctcagcctcctt

SEQ ID NO: 8845 - DNA, 20 bp, Artificial Sequence
  Primer
tcaggatccactgcaaggaa

SEQ ID NO: 8846 - DNA, 21 bp, Artificial Sequence
  Primer
gatgtgtgggagcacgcttac

SEQ ID NO: 8847 - DNA, 20 bp, Artificial Sequence
  Primer
taagcgtgctcccacacatc

SEQ ID NO: 8848 - DNA, 23 bp, Artificial Sequence
  Primer
actcagcataacgatcgtggttt

SEQ ID NO: 8849 - DNA, 20 bp, Artificial Sequence
  Primer
gggcctgaactagccaatca

SEQ ID NO: 8850 - DNA, 20 bp, Artificial Sequence
  Primer
acaagcgttgagccttggaa

SEQ ID NO: 8851 - DNA, 20 bp, Artificial Sequence
  Primer
aacgcttgtggagccttgtc

SEQ ID NO: 8852 - DNA, 20 bp, Artificial Sequence
  Primer
caaatggtcagcagccctct

SEQ ID NO: 8853 - DNA, 20 bp, Artificial Sequence
  Primer
agctgccttctgctctccag

SEQ ID NO: 8854 - DNA, 20 bp, Artificial Sequence
  Primer
tgcagcctcacctctgagaa

SEQ ID NO: 8855 - DNA, 20 bp, Artificial Sequence
  Primer
gaagcttcctcgcggtgtaa

SEQ ID NO: 8856 - DNA, 20 bp, Artificial Sequence
  Primer
agagcgctggagagcagaag

SEQ ID NO: 8857 - DNA, 20 bp, Artificial Sequence
  Primer
gacagcctgggctggtaaaa

SEQ ID NO: 8858 - DNA, 20 bp, Artificial Sequence
  Primer
tgtgacacctgctgcactca

SEQ ID NO: 8859 - DNA, 20 bp, Artificial Sequence
  Primer
cgtcttcctttcctcgtgct

SEQ ID NO: 8860 - DNA, 20 bp, Artificial Sequence
  Primer
cagtttccacccagctccat

SEQ ID NO: 8861 - DNA, 20 bp, Artificial Sequence
  Primer
tccctccatcatcgacactg

SEQ ID NO: 8862 - DNA, 25 bp, Artificial Sequence
  Primer
gtctagcctcagagtaacccctgtt

SEQ ID NO: 8863 - DNA, 22 bp, Artificial Sequence
  Primer
ttggcataaaataagcgacgaa

SEQ ID NO: 8864 - DNA, 22 bp, Artificial Sequence
  Primer
ttggcataaaataagcgacgaa

SEQ ID NO: 8865 - DNA, 20 bp, Artificial Sequence
  Primer
agtgcttgggctacgaatgc

SEQ ID NO: 8866 - DNA, 20 bp, Artificial Sequence
  Primer
atggctgctagccaaaccac

SEQ ID NO: 8867 - DNA, 20 bp, Artificial Sequence
  Primer
gcttcctcatgccagtcagc

SEQ ID NO: 8868 - DNA, 20 bp, Artificial Sequence
  Primer
cccttccccaggacttttgt

SEQ ID NO: 8869 - DNA, 20 bp, Artificial Sequence
  Primer
agctgccttctgctctccag

SEQ ID NO: 8870 - DNA, 20 bp, Artificial Sequence
  Primer
tgcagcctcacctctgagaa

SEQ ID NO: 8871 - DNA, 20 bp, Artificial Sequence
  Primer
gaagcttcctcgcggtgtaa

SEQ ID NO: 8872 - DNA, 20 bp, Artificial Sequence
  Primer
agagcgctggagagcagaag

SEQ ID NO: 8873 - DNA, 20 bp, Artificial Sequence
  Primer
ctggaggccctcttgtgtgt

SEQ ID NO: 8874 - DNA, 20 bp, Artificial Sequence
  Primer
aaacaatggcatgcctccac

SEQ ID NO: 8875 - DNA, 20 bp, Artificial Sequence
  Primer
agactttggtgcaggctcgt

SEQ ID NO: 8876 - DNA, 21 bp, Artificial Sequence
  Primer
ggggcttagtttgcttcctgt

SEQ ID NO: 8877 - DNA, 20 bp, Artificial Sequence
  Primer
ggcagcaactccgagagaaa

SEQ ID NO: 8878 - DNA, 22 bp, Artificial Sequence
  Primer
tgcagtgtggacattcaacaga

SEQ ID NO: 8879 - DNA, 20 bp, Artificial Sequence
  Primer
gcaggctggattctttggtg

SEQ ID NO: 8880 - DNA, 20 bp, Artificial Sequence
  Primer
tctcggagttgctgccaata

SEQ ID NO: 8881 - DNA, 24 bp, Artificial Sequence
  Primer
gcgtataatccaaatggaaatgct

SEQ ID NO: 8882 - DNA, 20 bp, Artificial Sequence
  Primer
tggctctgcactctcccagt

SEQ ID NO: 8883 - DNA, 24 bp, Artificial Sequence
  Primer
tgttgggtctttactctccacctt

SEQ ID NO: 8884 - DNA, 28 bp, Artificial Sequence
  Primer
tgagctgttgcttacagatataacgatt

SEQ ID NO: 8885 - DNA, 20 bp, Artificial Sequence
  Primer
cacccagttgaaagctgcac

SEQ ID NO: 8886 - DNA, 22 bp, Artificial Sequence
  Primer
tggctttcagcttggaatttct

SEQ ID NO: 8887 - DNA, 20 bp, Artificial Sequence
  Primer
tcagttgggcatcactcagg

SEQ ID NO: 8888 - DNA, 20 bp, Artificial Sequence
  Primer
ctgggtggaggctgctattc

SEQ ID NO: 8889 - DNA, 24 bp, Artificial Sequence
  Primer
acgtggtacagaatccaaaagtca

SEQ ID NO: 8890 - DNA, 27 bp, Artificial Sequence
  Primer
attacgtggtacagaatccaaaagtca

SEQ ID NO: 8891 - DNA, 28 bp, Artificial Sequence
  Primer
tgcttgtaaatgcagtaagtatctttgg

SEQ ID NO: 8892 - DNA, 29 bp, Artificial Sequence
  Primer
gtgcttgtaaatgcagtaagtatctttgg

SEQ ID NO: 8893 - DNA, 20 bp, Artificial Sequence
  Primer
gcaaacatggcttgttccaa

SEQ ID NO: 8894 - DNA, 20 bp, Artificial Sequence
  Primer
gaaggcacagccctctttca

SEQ ID NO: 8895 - DNA, 20 bp, Artificial Sequence
  Primer
tctgccaggggcaaaagata

SEQ ID NO: 8896 - DNA, 20 bp, Artificial Sequence
  Primer
attgggtgcccagtgctatc

SEQ ID NO: 8897 - DNA, 20 bp, Artificial Sequence
  Primer
agctgccttctgctctccag

SEQ ID NO: 8898 - DNA, 20 bp, Artificial Sequence
  Primer
tgcagcctcacctctgagaa

SEQ ID NO: 8899 - DNA, 20 bp, Artificial Sequence
  Primer
gaagcttcctcgcggtgtaa

SEQ ID NO: 8900 - DNA, 20 bp, Artificial Sequence
  Primer
agagcgctggagagcagaag

SEQ ID NO: 8901 - DNA, 20 bp, Artificial Sequence
  Primer
gcaaacatggcttgttccaa

SEQ ID NO: 8902 - DNA, 20 bp, Artificial Sequence
  Primer
gaaggcacagccctctttca

SEQ ID NO: 8903 - DNA, 20 bp, Artificial Sequence
  Primer
tctgccaggggcaaaagata

SEQ ID NO: 8904 - DNA, 20 bp, Artificial Sequence
  Primer
attgggtgcccagtgctatc

SEQ ID NO: 8905 - DNA, 20 bp, Artificial Sequence
  Primer
acgagcctgcaccaaagtct

SEQ ID NO: 8906 - DNA, 26 bp, Artificial Sequence
  Primer
gcagcaaatctagctttcagtattcc

SEQ ID NO: 8907 - DNA, 20 bp, Artificial Sequence
  Primer
tcattacagcgggggcttag

SEQ ID NO: 8908 - DNA, 22 bp, Artificial Sequence
  Primer
tgctgcattcttgaagttggtt

SEQ ID NO: 8909 - DNA, 20 bp, Artificial Sequence
  Primer
tgcaatcaggaaaacgaacg

SEQ ID NO: 8910 - DNA, 22 bp, Artificial Sequence
  Primer
tcatttgcaatcaggaaaacga

SEQ ID NO: 8911 - DNA, 26 bp, Artificial Sequence
  Primer
caccactcactttaagcttcagacac

SEQ ID NO: 8912 - DNA, 27 bp, Artificial Sequence
  Primer
aagcttcagacactcttagtttcttgc

SEQ ID NO: 8913 - DNA, 20 bp, Artificial Sequence
  Primer
tggacattgtctgcgtggtt

SEQ ID NO: 8914 - DNA, 20 bp, Artificial Sequence
  Primer
gggctgctacccagaaatca

SEQ ID NO: 8915 - DNA, 20 bp, Artificial Sequence
  Primer
tgggtagcagcccagagttc

SEQ ID NO: 8916 - DNA, 20 bp, Artificial Sequence
  Primer
ttctgccatggcctctgttt

SEQ ID NO: 8917 - DNA, 21 bp, Artificial Sequence
  Primer
ccttaaggcaaaaggcagagg

SEQ ID NO: 8918 - DNA, 20 bp, Artificial Sequence
  Primer
gctggacagcaaacatggag

SEQ ID NO: 8919 - DNA, 20 bp, Artificial Sequence
  Primer
ccagaagacaggagcgcagt

SEQ ID NO: 8920 - DNA, 20 bp, Artificial Sequence
  Primer
tgctgccatgtaacccattg

SEQ ID NO: 8921 - DNA, 24 bp, Artificial Sequence
  Primer
tgatactcccagtcttgtcattgc

SEQ ID NO: 8922 - DNA, 27 bp, Artificial Sequence
  Primer
tcctagtttgatactcccagtcttgtc

SEQ ID NO: 8923 - DNA, 24 bp, Artificial Sequence
  Primer
gactgtggagttttggctgtttta

SEQ ID NO: 8924 - DNA, 24 bp, Artificial Sequence
  Primer
attgactgtggagttttggctgtt

SEQ ID NO: 8925 - DNA, 20 bp, Artificial Sequence
  Primer
ccccaccaagaacaacaagg

SEQ ID NO: 8926 - DNA, 20 bp, Artificial Sequence
  Primer
cccttggctgtgacacaaga

SEQ ID NO: 8927 - DNA, 20 bp, Artificial Sequence
  Primer
tacggacaatgccatcctca

SEQ ID NO: 8928 - DNA, 20 bp, Artificial Sequence
  Primer
gcaccagggagggaaaagat

SEQ ID NO: 8929 - DNA, 20 bp, Artificial Sequence
  Primer
actaggcgtcctcccgactc

SEQ ID NO: 8930 - DNA, 20 bp, Artificial Sequence
  Primer
ccgagcccttcctagtggat

SEQ ID NO: 8931 - DNA, 20 bp, Artificial Sequence
  Primer
ctagcccctgctctgtgcat

SEQ ID NO: 8932 - DNA, 20 bp, Artificial Sequence
  Primer
gtgtccggctcacaaactcc

SEQ ID NO: 8933 - DNA, 20 bp, Artificial Sequence
  Primer
caagcacaacccaccacaac

SEQ ID NO: 8934 - DNA, 20 bp, Artificial Sequence
  Primer
cctgctccctgtctgtgtcc

SEQ ID NO: 8935 - DNA, 20 bp, Artificial Sequence
  Primer
tggtgccgacagcatcttta

SEQ ID NO: 8936 - DNA, 20 bp, Artificial Sequence
  Primer
cccagccacacacgtcatta

SEQ ID NO: 8937 - DNA, 22 bp, Artificial Sequence
  Primer
tgggtgttgcaaactgaagaag

SEQ ID NO: 8938 - DNA, 23 bp, Artificial Sequence
  Primer
tttcagattcccacatgaaaagg

SEQ ID NO: 8939 - DNA, 22 bp, Artificial Sequence
  Primer
ccctaggtactcctccctgagc

SEQ ID NO: 8940 - DNA, 21 bp, Artificial Sequence
  Primer
gcctggaaataagcccaaaca

SEQ ID NO: 8941 - DNA, 21 bp, Artificial Sequence
  Primer
tgtccctgaaaattccctggt

SEQ ID NO: 8942 - DNA, 21 bp, Artificial Sequence
  Primer
gtctgaggcctgcctcctaat

SEQ ID NO: 8943 - DNA, 20 bp, Artificial Sequence
  Primer
gcatagccgtagaccggatg

SEQ ID NO: 8944 - DNA, 20 bp, Artificial Sequence
  Primer
ccagggaattttcagggaca

SEQ ID NO: 8945 - DNA, 20 bp, Artificial Sequence
  Primer
acaccctggtgtgccatttt

SEQ ID NO: 8946 - DNA, 20 bp, Artificial Sequence
  Primer
ctcattgggtggatggatgg

SEQ ID NO: 8947 - DNA, 20 bp, Artificial Sequence
  Primer
agatccctcctcacccatcc

SEQ ID NO: 8948 - DNA, 20 bp, Artificial Sequence
  Primer
cggctttctgtggctttctt

SEQ ID NO: 8949 - DNA, 20 bp, Artificial Sequence
  Primer
gccaccctaggcttccaaat

SEQ ID NO: 8950 - DNA, 22 bp, Artificial Sequence
  Primer
ttgctgaaggagaaaggagctt

SEQ ID NO: 8951 - DNA, 21 bp, Artificial Sequence
  Primer
gggccaaagaatttaccgaaa

SEQ ID NO: 8952 - DNA, 22 bp, Artificial Sequence
  Primer
ggccctgatactcctattgtgg

SEQ ID NO: 8953 - DNA, 20 bp, Artificial Sequence
  Primer
gctcattgctccaggctttg

SEQ ID NO: 8954 - DNA, 26 bp, Artificial Sequence
  Primer
gcagcaaatctagctttcagtattcc

SEQ ID NO: 8955 - DNA, 25 bp, Artificial Sequence
  Primer
gcttctcccaagaaagagctaaaga

SEQ ID NO: 8956 - DNA, 22 bp, Artificial Sequence
  Primer
tgctgcattcttgaagttggtt

SEQ ID NO: 8957 - DNA, 20 bp, Artificial Sequence
  Primer
ccaaaacctgcccctactcc

SEQ ID NO: 8958 - DNA, 20 bp, Artificial Sequence
  Primer
cggaagcctattcgcaggat

SEQ ID NO: 8959 - DNA, 20 bp, Artificial Sequence
  Primer
tgggttgaggtgatgatgga

SEQ ID NO: 8960 - DNA, 20 bp, Artificial Sequence
  Primer
cagcgagggctgtgagtttt

SEQ ID NO: 8961 - DNA, 20 bp, Artificial Sequence
  Primer
ccccagcgaggtactcttca

SEQ ID NO: 8962 - DNA, 22 bp, Artificial Sequence
  Primer
agatgctgcttcttcaatgcaa

SEQ ID NO: 8963 - DNA, 20 bp, Artificial Sequence
  Primer
cagctttcgttggcatcctt

SEQ ID NO: 8964 - DNA, 22 bp, Artificial Sequence
  Primer
tggctgaacttagtagccgtca

SEQ ID NO: 8965 - DNA, 22 bp, Artificial Sequence
  Primer
ttccaggggaagtactgtttgg

SEQ ID NO: 8966 - DNA, 23 bp, Artificial Sequence
  Primer
gtcataccctaatgatcccagca

SEQ ID NO: 8967 - DNA, 21 bp, Artificial Sequence
  Primer
accaggcttgatgcacatctt

SEQ ID NO: 8968 - DNA, 24 bp, Artificial Sequence
  Primer
tccaggaccttatagggttttcag

SEQ ID NO: 8969 - DNA, 21 bp, Artificial Sequence
  Primer
ctgtgtgctatccatgccaaa

SEQ ID NO: 8970 - DNA, 23 bp, Artificial Sequence
  Primer
aggggacagaaatcaggtattgg

SEQ ID NO: 8971 - DNA, 21 bp, Artificial Sequence
  Primer
aagcacgttctccacgtatgc

SEQ ID NO: 8972 - DNA, 22 bp, Artificial Sequence
  Primer
tgaaccgctgaaacttgttcac

SEQ ID NO: 8973 - DNA, 20 bp, Artificial Sequence
  Primer
ccctgctgctttgcctacat

SEQ ID NO: 8974 - DNA, 20 bp, Artificial Sequence
  Primer
gggctctgtgacaaggaagg

SEQ ID NO: 8975 - DNA, 20 bp, Artificial Sequence
  Primer
aaagacgactgctgggttgg

SEQ ID NO: 8976 - DNA, 20 bp, Artificial Sequence
  Primer
gctcctgtgaggggttgaga

SEQ ID NO: 8977 - DNA, 20 bp, Artificial Sequence
  Primer
cccttggacccagaggttct

SEQ ID NO: 8978 - DNA, 20 bp, Artificial Sequence
  Primer
ctggctcacctggacaacct

SEQ ID NO: 8979 - DNA, 20 bp, Artificial Sequence
  Primer
aggcaccgagcactttcttg

SEQ ID NO: 8980 - DNA, 20 bp, Artificial Sequence
  Primer
gcccaggagcctgaagttct

SEQ ID NO: 8981 - DNA, 20 bp, Artificial Sequence
  Primer
aaggaaattctggccgtggt

SEQ ID NO: 8982 - DNA, 20 bp, Artificial Sequence
  Primer
gctcccagtgccacaagaac

SEQ ID NO: 8983 - DNA, 20 bp, Artificial Sequence
  Primer
tgcaccctgaggagaggagt

SEQ ID NO: 8984 - DNA, 20 bp, Artificial Sequence
  Primer
tcgggtcagatcttccaagg

SEQ ID NO: 8985 - DNA, 20 bp, Artificial Sequence
  Primer
ggggtcagcaagtcatcaca

SEQ ID NO: 8986 - DNA, 21 bp, Artificial Sequence
  Primer
gctgaagcatctgctccattg

SEQ ID NO: 8987 - DNA, 20 bp, Artificial Sequence
  Primer
cacaatgatgggctgaccaa

SEQ ID NO: 8988 - DNA, 20 bp, Artificial Sequence
  Primer
tgaatggcaccatccacaga

SEQ ID NO: 8989 - DNA, 20 bp, Artificial Sequence
  Primer
ctcccggaaacgctatcaaa

SEQ ID NO: 8990 - DNA, 23 bp, Artificial Sequence
  Primer
ggttgcaaaagcttctcatttca

SEQ ID NO: 8991 - DNA, 22 bp, Artificial Sequence
  Primer
ggatcctggcatctctctgaaa

SEQ ID NO: 8992 - DNA, 21 bp, Artificial Sequence
  Primer
tgccatccatccacttattcc

SEQ ID NO: 8993 - DNA, 20 bp, Artificial Sequence
  Primer
ttttctggaggccatgcaat

SEQ ID NO: 8994 - DNA, 20 bp, Artificial Sequence
  Primer
tctgccgaggaagacactga

SEQ ID NO: 8995 - DNA, 21 bp, Artificial Sequence
  Primer
tgagctgcatgactgtgaacc

SEQ ID NO: 8996 - DNA, 20 bp, Artificial Sequence
  Primer
ttcatcaaacccctgccatc

SEQ ID NO: 8997 - DNA, 20 bp, Artificial Sequence
  Primer
tggctgcacaggctgaaata

SEQ ID NO: 8998 - DNA, 20 bp, Artificial Sequence
  Primer
cctggctgggtggtattctg

SEQ ID NO: 8999 - DNA, 20 bp, Artificial Sequence
  Primer
gggttgtacggtgggaatca

SEQ ID NO: 9000 - DNA, 20 bp, Artificial Sequence
  Primer
gatgtaaggcctggccacag

SEQ ID NO: 9001 - DNA, 31 bp, Artificial Sequence
  Primer
tgtgtgctttattgaattagaaaattagtga

SEQ ID NO: 9002 - DNA, 31 bp, Artificial Sequence
  Primer
gtcactatatcttcccatttaacattgtttt

SEQ ID NO: 9003 - DNA, 22 bp, Artificial Sequence
  Primer
caactacctccacatccccaaa

SEQ ID NO: 9004 - DNA, 26 bp, Artificial Sequence
  Primer
tgcaaattgtaagtcacaaggatttt

SEQ ID NO: 9005 - DNA, 20 bp, Artificial Sequence
  Primer
aggaggaaggggacagttgc

SEQ ID NO: 9006 - DNA, 20 bp, Artificial Sequence
  Primer
ccaaaagcatgcgtcagcta

SEQ ID NO: 9007 - DNA, 20 bp, Artificial Sequence
  Primer
tagctgacgcatgcttttgg

SEQ ID NO: 9008 - DNA, 20 bp, Artificial Sequence
  Primer
tctacggaggggtgaggatg

SEQ ID NO: 9009 - DNA, 21 bp, Artificial Sequence
  Primer
agctctgcttttggctgtacg

SEQ ID NO: 9010 - DNA, 22 bp, Artificial Sequence
  Primer
aaggcaaaccttatgacccaca

SEQ ID NO: 9011 - DNA, 21 bp, Artificial Sequence
  Primer
cccaaatacagcgctctcaaa

SEQ ID NO: 9012 - DNA, 21 bp, Artificial Sequence
  Primer
ggaacgtacagccaaaagcag

SEQ ID NO: 9013 - DNA, 20 bp, Artificial Sequence
  Primer
gggatgcagtacccacttgc

SEQ ID NO: 9014 - DNA, 20 bp, Artificial Sequence
  Primer
ccagtgatgccttgatgctg

SEQ ID NO: 9015 - DNA, 20 bp, Artificial Sequence
  Primer
tttaaggcgttgcagcatca

SEQ ID NO: 9016 - DNA, 23 bp, Artificial Sequence
  Primer
tctagctttggttcgagctttga

SEQ ID NO: 9017 - DNA, 20 bp, Artificial Sequence
  Primer
ggcagcttcacaaggcaagt

SEQ ID NO: 9018 - DNA, 20 bp, Artificial Sequence
  Primer
tgcaaagcctgaggacactg

SEQ ID NO: 9019 - DNA, 20 bp, Artificial Sequence
  Primer
acgggcagtttgcttcttca

SEQ ID NO: 9020 - DNA, 20 bp, Artificial Sequence
  Primer
gaagggaggggagctctgac

SEQ ID NO: 9021 - DNA, 20 bp, Artificial Sequence
  Primer
cctctgtccaacgcaaaacc

SEQ ID NO: 9022 - DNA, 20 bp, Artificial Sequence
  Primer
ggagaaggatgtgccaccag

SEQ ID NO: 9023 - DNA, 20 bp, Artificial Sequence
  Primer
ttaggtcctgtccccggatt

SEQ ID NO: 9024 - DNA, 19 bp, Artificial Sequence
  Primer
cagctctgggtccctagcc

SEQ ID NO: 9025 - DNA, 24 bp, Artificial Sequence
  Primer
cgaggaggttgtataaaggggaaa

SEQ ID NO: 9026 - DNA, 24 bp, Artificial Sequence
  Primer
cgaggaggttgtataaaggggaaa

SEQ ID NO: 9027 - DNA, 27 bp, Artificial Sequence
  Primer
aagaggaggaagatgatagattggtct

SEQ ID NO: 9028 - DNA, 29 bp, Artificial Sequence
  Primer
ggaggaagatgatagattggtctaaattc

SEQ ID NO: 9029 - DNA, 20 bp, Artificial Sequence
  Primer
actttccgctccagcctctt

SEQ ID NO: 9030 - DNA, 20 bp, Artificial Sequence
  Primer
ggacctgctgagcacagtga

SEQ ID NO: 9031 - DNA, 20 bp, Artificial Sequence
  Primer
gtcctgaccacgaccctgac

SEQ ID NO: 9032 - DNA, 20 bp, Artificial Sequence
  Primer
gcccacaggctcttctctca

SEQ ID NO: 9033 - DNA, 29 bp, Artificial Sequence
  Primer
tttttggtgtgataacttgtttcttatcc

SEQ ID NO: 9034 - DNA, 28 bp, Artificial Sequence
  Primer
ttggtgtgataacttgtttcttatcctt

SEQ ID NO: 9035 - DNA, 23 bp, Artificial Sequence
  Primer
tctccttcaatttccacacactg

SEQ ID NO: 9036 - DNA, 24 bp, Artificial Sequence
  Primer
tctccttcaatttccacacactga

SEQ ID NO: 9037 - DNA, 20 bp, Artificial Sequence
  Primer
ccccttggggttttctgagt

SEQ ID NO: 9038 - DNA, 20 bp, Artificial Sequence
  Primer
acctgcttggtgggaaacaa

SEQ ID NO: 9039 - DNA, 20 bp, Artificial Sequence
  Primer
ttgtttcccaccaagcaggt

SEQ ID NO: 9040 - DNA, 20 bp, Artificial Sequence
  Primer
tgcccatgcagggaaattat

SEQ ID NO: 9041 - DNA, 20 bp, Artificial Sequence
  Primer
tgaaatggccatggtgactg

SEQ ID NO: 9042 - DNA, 20 bp, Artificial Sequence
  Primer
actgagaggctaccccagca

SEQ ID NO: 9043 - DNA, 20 bp, Artificial Sequence
  Primer
atcccctccttcctgggttt

SEQ ID NO: 9044 - DNA, 19 bp, Artificial Sequence
  Primer
gggagagacgggagtttgg

SEQ ID NO: 9045 - DNA, 20 bp, Artificial Sequence
  Primer
gctttgctcaaggcttcgat

SEQ ID NO: 9046 - DNA, 20 bp, Artificial Sequence
  Primer
agtacttggcgtgcacgatg

SEQ ID NO: 9047 - DNA, 20 bp, Artificial Sequence
  Primer
gcgaagaagacgctcgattt

SEQ ID NO: 9048 - DNA, 20 bp, Artificial Sequence
  Primer
ggcctcgagctgcgtatcta

SEQ ID NO: 9049 - DNA, 23 bp, Artificial Sequence
  Primer
catgtcagaaggaatgagagcag

SEQ ID NO: 9050 - DNA, 27 bp, Artificial Sequence
  Primer
caatttaaatcttattgctttgccagt

SEQ ID NO: 9051 - DNA, 27 bp, Artificial Sequence
  Primer
cttacagagggattaagtcctagcaaa

SEQ ID NO: 9052 - DNA, 26 bp, Artificial Sequence
  Primer
ggatttatccttttcttcatgtgcaa

SEQ ID NO: 9053 - DNA, 20 bp, Artificial Sequence
  Primer
gggactggctgctagggatt

SEQ ID NO: 9054 - DNA, 20 bp, Artificial Sequence
  Primer
ccctctgtacccgcaatacg

SEQ ID NO: 9055 - DNA, 20 bp, Artificial Sequence
  Primer
aacccgggtgtctatgtcca

SEQ ID NO: 9056 - DNA, 20 bp, Artificial Sequence
  Primer
ccttcatatgctccgccagt

SEQ ID NO: 9057 - DNA, 20 bp, Artificial Sequence
  Primer
ctggtggggccaatatttca

SEQ ID NO: 9058 - DNA, 20 bp, Artificial Sequence
  Primer
ggctctcccttggcaaagtt

SEQ ID NO: 9059 - DNA, 20 bp, Artificial Sequence
  Primer
cgaccaaaccttaccggaga

SEQ ID NO: 9060 - DNA, 20 bp, Artificial Sequence
  Primer
gtccccaaagggaaagatgg

SEQ ID NO: 9061 - DNA, 22 bp, Artificial Sequence
  Primer
cagttttgaaggttctggcaca

SEQ ID NO: 9062 - DNA, 27 bp, Artificial Sequence
  Primer
ggataagcaatagattgtgtgggaaat

SEQ ID NO: 9063 - DNA, 20 bp, Artificial Sequence
  Primer
tcttagggaaggggcctcaa

SEQ ID NO: 9064 - DNA, 22 bp, Artificial Sequence
  Primer
tgtgccagaaccttcaaaactg

SEQ ID NO: 9065 - DNA, 20 bp, Artificial Sequence
  Primer
atgattggctttggcggtta

SEQ ID NO: 9066 - DNA, 22 bp, Artificial Sequence
  Primer
tgaaagtggatgattggctttg

SEQ ID NO: 9067 - DNA, 20 bp, Artificial Sequence
  Primer
cttccattcctcagcctcca

SEQ ID NO: 9068 - DNA, 20 bp, Artificial Sequence
  Primer
ttccattcctcagcctccag

SEQ ID NO: 9069 - DNA, 23 bp, Artificial Sequence
  Primer
aacgtgtatgcaacaacattcca

SEQ ID NO: 9070 - DNA, 24 bp, Artificial Sequence
  Primer
tcctccctccaaaatagtgtgttc

SEQ ID NO: 9071 - DNA, 24 bp, Artificial Sequence
  Primer
gcactgaattattgtgagctggtg

SEQ ID NO: 9072 - DNA, 29 bp, Artificial Sequence
  Primer
ctgtagggacaaagttatatggaatgttt

SEQ ID NO: 9073 - DNA, 20 bp, Artificial Sequence
  Primer
ttggctgcagggtacacaaa

SEQ ID NO: 9074 - DNA, 20 bp, Artificial Sequence
  Primer
tgtcctctttgccccacagt

SEQ ID NO: 9075 - DNA, 20 bp, Artificial Sequence
  Primer
agccatttcacaaacgcaca

SEQ ID NO: 9076 - DNA, 20 bp, Artificial Sequence
  Primer
accacgaccgagtgggtact

SEQ ID NO: 9077 - DNA, 20 bp, Artificial Sequence
  Primer
tgaaggggaagggttttgtg

SEQ ID NO: 9078 - DNA, 20 bp, Artificial Sequence
  Primer
gcgttctgagtgtggacgag

SEQ ID NO: 9079 - DNA, 20 bp, Artificial Sequence
  Primer
gaagacagcgccattgttcc

SEQ ID NO: 9080 - DNA, 20 bp, Artificial Sequence
  Primer
gcagacagcgaccctcattc

SEQ ID NO: 9081 - DNA, 20 bp, Artificial Sequence
  Primer
ggcctctctggaaagggtgt

SEQ ID NO: 9082 - DNA, 20 bp, Artificial Sequence
  Primer
ggtggcgccctaaatgatct

SEQ ID NO: 9083 - DNA, 20 bp, Artificial Sequence
  Primer
cgcaaagcaaacccacctaa

SEQ ID NO: 9084 - DNA, 20 bp, Artificial Sequence
  Primer
agagccccaagctcttgtcc

SEQ ID NO: 9085 - DNA, 20 bp, Artificial Sequence
  Primer
ccccaagtgagctgcaagag

SEQ ID NO: 9086 - DNA, 20 bp, Artificial Sequence
  Primer
gctcttcttggtggggcttt

SEQ ID NO: 9087 - DNA, 20 bp, Artificial Sequence
  Primer
aaagccccaccaagaagagc

SEQ ID NO: 9088 - DNA, 20 bp, Artificial Sequence
  Primer
ggcatccagtgacacgactg

SEQ ID NO: 9089 - DNA, 20 bp, Artificial Sequence
  Primer
tggggaagcagatttgggta

SEQ ID NO: 9090 - DNA, 20 bp, Artificial Sequence
  Primer
tagcccacacgttcccctta

SEQ ID NO: 9091 - DNA, 20 bp, Artificial Sequence
  Primer
ttcatggtggctggcagtaa

SEQ ID NO: 9092 - DNA, 20 bp, Artificial Sequence
  Primer
atggagagctcccgtgagtg

SEQ ID NO: 9093 - DNA, 21 bp, Artificial Sequence
  Primer
ggttcccattgtgagtgtgct

SEQ ID NO: 9094 - DNA, 20 bp, Artificial Sequence
  Primer
ttcagacctcccttgccaac

SEQ ID NO: 9095 - DNA, 20 bp, Artificial Sequence
  Primer
ttggcaagggaggtctgaag

SEQ ID NO: 9096 - DNA, 21 bp, Artificial Sequence
  Primer
cctgttcatcagcatcccact

SEQ ID NO: 9097 - DNA, 22 bp, Artificial Sequence
  Primer
tttgggagttttgctgattcct

SEQ ID NO: 9098 - DNA, 25 bp, Artificial Sequence
  Primer
tttaatttgggagttttgctgattc

SEQ ID NO: 9099 - DNA, 20 bp, Artificial Sequence
  Primer
tttggggtgttgagggagtc

SEQ ID NO: 9100 - DNA, 20 bp, Artificial Sequence
  Primer
tttggggtgttgagggagtc

SEQ ID NO: 9101 - DNA, 20 bp, Artificial Sequence
  Primer
catggtggggcaatggttat

SEQ ID NO: 9102 - DNA, 20 bp, Artificial Sequence
  Primer
gtcttcccaagccccatgtt

SEQ ID NO: 9103 - DNA, 21 bp, Artificial Sequence
  Primer
gggtgtgcatgaaggctctta

SEQ ID NO: 9104 - DNA, 23 bp, Artificial Sequence
  Primer
tgtatgtccctccctcatttcaa

SEQ ID NO: 9105 - DNA, 20 bp, Artificial Sequence
  Primer
gttccccaaatgggaacaca

SEQ ID NO: 9106 - DNA, 20 bp, Artificial Sequence
  Primer
aagcaggttccccaggattc

SEQ ID NO: 9107 - DNA, 20 bp, Artificial Sequence
  Primer
tccctaccctggctttcctc

SEQ ID NO: 9108 - DNA, 20 bp, Artificial Sequence
  Primer
gaagaacaaggagggcaacg

SEQ ID NO: 9109 - DNA, 2150 bp, Homo sapiens
gcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctgctatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagacttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcatccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 9110 - DNA, 696 bp, Homo sapiens
ttccccccccccccccccccccccgcccgagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcctatggggatggtccactgtcactgtttctctgctgttgcaaatacatggataacacatttgattctgtgtgttttccataataaaactttaaaataaaatgcagacagtta

SEQ ID NO: 9111 - DNA, 1242 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaa

SEQ ID NO: 9112 - DNA, 1271 bp, Homo sapiens
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatataatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaa

SEQ ID NO: 9113 - DNA, 1026 bp, Homo sapiens
cagcatgttgagccgggcagtgtgcggcaccagcaggcagctgcctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaactggactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctag

SEQ ID NO: 9114 - DNA, 960 bp, Homo sapiens
agcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 9115 - DNA, 3809 bp, Homo sapiens
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacggtcccaggcccagagaagatgagtctatggcatcaggttcttaaaccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagcgcagctcagctgcactgcgttccgaggtgaagtcttgcccctgaattttgcaaaatgggaaagtgggcgcttgccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgta

SEQ ID NO: 9116 - DNA, 738 bp, Homo sapiens
aaagcagaattgagagtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttga

SEQ ID NO: 9117 - DNA, 4034 bp, Homo sapiens
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcccgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttataaagaaaaatctttgttactctgtaaatgaaaaaacccattttcgctataaataaaaggtaactgtacaaaataagtacaat

SEQ ID NO: 9118 - DNA, 572 bp, Homo sapiens
ttttggggacttcttagcttgctctctcctgagtcccactggccaccccagcacacagcagaggcctagcaagtctcaagtgaggcaatcctggactagggcaaacatggcttgttccaaaagccgggggttaaggaatcaaagtcaggtgaaactatcactttcacaaaagcttttcttgactcctgggcctagtatcttttgcccctggcagaatgtaacagcaaaatgtctccttctgaaacggaaggcacagccctctttcagaagcaaaacaccttaacactcggcttctatttgcttaagaatttacaaatagaaatgagaatcaaaggttttaactcatctgatagcactgggcacccaatgttcacagcctgcttctttgaattgttagtgtctccccaataaataaatacagaaccttggatacccttcgaattttaaaataccttaaagtcttccattaatcttattttttaaaaatgctaggtttgtttcagttacctgcagcaatcaaaaagctttggcaccttcttttagagaattgcacaaaacaggatgcatcaagg

SEQ ID NO: 9119 - DNA, 358 bp, Homo sapiens
gggtttatcccaggatattcattgatagaaaattaaaggagtaatttataaaatcactacatgaacaagtaaaaacacacacagcaaaatttacatcaaaattattacgtggtacagaatccaaaagtcataaaaagcaaaagctatctttttttcactctggcacccatctgttcttccctggagtcaaacactattaccaatttttaggtatacttccaaagatacttactgcatttacaagcacagacttatattgattctaaaagaataagagacattttcagcatgttgctttgttcaacaccacagtatatcttaaagatggtcccccatcaatacatatagagatctctct

SEQ ID NO: 9120 - DNA, 611 bp, Homo sapiens
  misc_feature (543)..(543): n= A, C, G or T
ttttttatgggtttccttaaatgtttttatggttaaaatctgtacaaacagatatatttatataagttacatattttaagaaaaatcagtcatttttcatatataattgcaaagaattaagatcatttaactttagcactataagcaagcattaaattaaatgcactcagatttttggcacattatatggcattccttataccacatatttataagatctaaaggattataaacatattacacataataattaagtccaatataaattgtgttcaggttataaaatgccctatttaagttgtgctcttggtgagggtgaacagaaaagaaaaggcttcttctttagcccttaagcctatgacacaatttccatgctggtaattcctttcatcttctgaagaatctctattttattataacattattggctttcagcttggaatttctctacgcagattgtctattgacagtgccaaggaaacatctcactgtccacagaatagcagcctccacccagttgaaagctgcacattgtttccactntaccattggtacttccctctgatggcatccagcacacgaccattagcctgagtgatgcccaactgagc

SEQ ID NO: 9121 - DNA, 573 bp, Homo sapiens
  misc_feature (521)..(521): n= A, C, G or T
gattgtataaataatttatttctgttcacagcatcatatatgcattataaaaggctatggaaacaaaagagaaggatgatgagacagagaattacagcagtagaaaggaaaacagaaaccagggcacacagttccaacaccagaacagagaatttgggaagataattgctctgaaacagaactggcctccctgtgtctattagaaaacatttccaaagctcacggagggaggccaacttcccctatgggaaacccattcactcgccaaagggcagaaggcatcataaatcacccattgatacattggtggggggctcctgtccccctggtgaccactccaaggtgatttgatctgtgcttcctctgttgggtcagagacgaaacgggctattattaggtcaaacattacagaaatcaactgagactcttaactagtagttgatacaccacagggctttactttactgcacaattactaacagttgattgcacccttaagtattgattatgcaaaaaacaanatcatctcgcatcagttttaaagcatgacagggtttgaacagtgatcttgaa

SEQ ID NO: 9122 - DNA, 1161 bp, Homo sapiens
caaagagctacatgccacatgctgttctccagcctgctgtgtgtatttgtggccttcagctactctggatcaagtgtggcccagaaggttactcaagcccagtcatcagtatccatgccagtgaggaaagcagtcaccctgaactgcctgtatgaaacaagttggtggtcatattatattttttggtacaagcaacttcccagcaaagagatgattttccttattcgccagggttctgatgaacagaatgcaaaaagtggtcgctattctgtcaacttcaagaaagcagcgaaatccgtcgccttaaccatttcagccttacagctagaagattcagcaaagtacttttgtgctcttgggacgggggtgaggggactccaggacaccgataaactcatctttggaaaaggaacccgtgtgactgtggaaccaagaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttgtaaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaa

SEQ ID NO: 9123 - DNA, 3102 bp, Homo sapiens
ggcacgaggcggggccgaggcgcgaggaggtgaggctggagcgcggccccctcgccttccctgttcccaggcaagctcccaaggcccgggcggcggggccgtcccgcgggccagccagatggcgacgtggcggttccccgcccgccgcgaccccaactccgggacgcacgctgcggacgcctatcctcccccaggccgctgacccgcctccctgcccggccggctcccgccgcggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctccaaaaaaaaaaaaaaaaaa

SEQ ID NO: 9124 - DNA, 3762 bp, Homo sapiens
agagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaagactgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaa

SEQ ID NO: 9125 - DNA, 1396 bp, Homo sapiens
gcgtaattaaaaggcggcggaagaaggtgggagggtcatgacgcagcgagtttcagtcgtgacttttctgggggcatcgcggcgtccccttttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcaaaaaaaaaaaaaaaaaaa

SEQ ID NO: 9126 - DNA, 4539 bp, Homo sapiens
cggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctacgacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgttccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccaaggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccacctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggaggtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctag

SEQ ID NO: 9127 - DNA, 1898 bp, Homo sapiens
agctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggatggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaaaaaaaaaaaaaaaaaaaaaaaaaaaaaaaa

SEQ ID NO: 9128 - DNA, 1503 bp, Homo sapiens
gttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttattttgcctgaaatcctactcgttgacatttgagattttaagctttgtggctgaaaatatatagatctctgag

SEQ ID NO: 9129 - DNA, 1258 bp, Homo sapiens
cacatatataatgaaaagtaatcagtctccaaagtttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccgaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaaaa

SEQ ID NO: 9130 - DNA, 626 bp, Homo sapiens
acatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgc

SEQ ID NO: 9131 - DNA, 1403 bp, Homo sapiens
ggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatgaaaaaaaaaaaaa

SEQ ID NO: 9132 - DNA, 16569 bp, Homo sapiens
gatcacaggtctatcaccctattaaccactcacgggagctctccatgcatttggtattttcgtctggggggtatgcacgcgatagcattgcgagacgctggagccggagcaccctatgtcgcagtatctgtctttgattcctgcctcatcctattatttatcgcacctacgttcaatattacaggcgaacatacttactaaagtgtgttaattaattaatgcttgtaggacataataataacaattgaatgtctgcacagccactttccacacagacatcataacaaaaaatttccaccaaaccccccctcccccgcttctggccacagcacttaaacacatctctgccaaaccccaaaaacaaagaaccctaacaccagcctaaccagatttcaaattttatcttttggcggtatgcacttttaacagtcaccccccaactaacacattattttcccctcccactcccatactactaatctcatcaatacaacccccgcccatcctacccagcacacacacaccgctgctaaccccataccccgaaccaaccaaaccccaaagacaccccccacagtttatgtagcttacctcctcaaagcaatacactgaaaatgtttagacgggctcacatcaccccataaacaaataggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaaccagagtgtagcttaacacaaagcacccaacttacacttaggagatttcaacttaacttgaccgctctgagctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaaatagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctaccttcaaattcctccctgtacgaaaggacaagagaaataaggcctacttcacaaagcgccttcccccgtaaatgatatcatctcaacttagtattatacccacacccacccaagaacagggtttgttaagatggcagagcccggtaatcgcataaaacttaaaactttacagtcagaggttcaattcctcttcttaacaacatacccatggccaacctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacctaagaaatatgtctgataaaagagttactttgatagagtaaataataggagcttaaacccccttatttctaggactatgagaatcgaacccatccctgagaatccaaaattctccgtgccacctatcacaccccatcctaaagtaaggtcagctaaataagctatcgggcccataccccgaaaatgttggttatacccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatagctatagcaataaaactaggaatagccccctttcacttctgagtcccagaggttacccaaggcacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccagacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcgcccttaccacgctactcctacctatctccccttttatactaataatcttatagaaatttaggttaaatacagaccaagagccttcaaagccctcagtaagttgcaatacttaatttctgtaacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccccactgatgttcgccgaccgttgactattctctacaaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaaggtattagaaaaaccatttcataactttgtcaaagttaaattataggctaaatcctatatatcttaatggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcccactgtaaagctaacttagcattaaccttttaagttaaagattaagagaaccaacacctctttacagtgaaatgccccaactaaatactaccgtatggcccaccataattacccccatactccttacactattcctcatcacccaactaaaaatattaaacacaaactaccacctacctccctcaccaaagcccataaaaataaaaaattataacaaaccctgagaaccaaaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcacagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacataatgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcttactcttttagtataaatagtaccgttaacttccaattaactagttttgacaacattcaaaaaagagtaataaacttcgccttaattttaataatcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgaattggtatatagtttaaacaaaacgaatgatttcgactcattaaattatgataatcatatttaccaaatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaataacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctcttgtaaatatagtttaaccaaaacatcagattgtgaatctgacaacagaggcttacgaccccttatttaccgagaaagctcacaagaactgctaactcatgcccccatgtctaacaacatggctttctcaacttttaaaggataacagctatccattggtcttaggccccaaaaattttggtgcaactccaaataaaagtaataaccatgcacactactataaccaccctaaccctgacttccctaattccccccatccttaccaccctcgttaaccctaacaaaaaaaactcatacccccattatgtaaaatccattgtcgcatccacctttattatcagtctcttccccacaacaatattcatgtgcctagaccaagaagttattatctcgaactgacactgagccacaacccaaacaacccagctctccctaagcttcaaactagactacttctccataatattcatccctgtagcattgttcgttacatggtccatcatagaattctcactgtgatatataaactcagacccaaacattaatcagttcttcaaatatctactcatcttcctaattaccatactaatcttagttaccgctaacaacctattccaactgttcatcggctgagagggcgtaggaattatatccttcttgctcatcagttgatgatacgcccgagcagatgccaacacagcagccattcaagcaatcctatacaaccgtatcggcgatatcggtttcatcctcgccttagcatgatttatcctacactccaactcatgagacccacaacaaatagcccttctaaacgctaatccaagcctcaccccactactaggcctcctcctagcagcagcaggcaaatcagcccaattaggtctccacccctgactcccctcagccatagaaggccccaccccagtctcagccctactccactcaagcactatagttgtagcaggaatcttcttactcatccgcttccaccccctagcagaaaatagcccactaatccaaactctaacactatgcttaggcgctatcaccactctgttcgcagcagtctgcgcccttacacaaaatgacatcaaaaaaatcgtagccttctccacttcaagtcaactaggactcataatagttacaatcggcatcaaccaaccacacctagcattcctgcacatctgtacccacgccttcttcaaagccatactatttatgtgctccgggtccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttccccacccttactaacattaacgaaaataaccccaccctactaaaccccattaaacgcctggcagccggaagcctattcgcaggatttctcattactaacaacatttcccccgcatcccccttccaaacaacaatccccctctacctaaaactcacagccctcgctgtcactttcctaggacttctaacagccctagacctcaactacctaaccaacaaacttaaaataaaatccccactatgcacattttatttctccaacatactcggattctaccctagcatcacacaccgcacaatcccctatctaggccttcttacgagccaaaacctgcccctactcctcctagacctaacctgactagaaaagctattacctaaaacaatttcacagcaccaaatctccacctccatcatcacctcaacccaaaaaggcataattaaactttacttcctctctttcttcttcccactcatcctaaccctactcctaatcacataacctattcccccgagcaatctcaattacaatatatacaccaacaaacaatgttcaaccagtaactactactaatcaacgcccataatcatacaaagcccccgcaccaataggatcctcccgaatcaaccctgacccctctccttcataaattattcagcttcctacactattaaagtttaccacaaccaccaccccatcatactctttcacccacagcaccaatcctacctccatcgctaaccccactaaaacactcaccaagacctcaacccctgacccccatgcctcaggatactcctcaatagccatcgctgtagtatatccaaagacaaccatcattccccctaaataaattaaaaaaactattaaacccatataacctcccccaaaattcagaataataacacacccgaccacaccgctaacaatcaatactaaacccccataaataggagaaggcttagaagaaaaccccacaaaccccattactaaacccacactcaacagaaacaaagcatacatcattattctcgcacggactacaaccacgaccaatgatatgaaaaaccatcgttgtatttcaactacaagaacaccaatgaccccaatacgcaaaattaaccccctaataaaattaattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcaacactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccacatcaagcccgaatgatatttcctattcgcctacacaattctccgatccgtccctaacaaactaggaggcgtccttgccctattactatccatcctcatcctagcaataatccccatcctccatatatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcctgtccttgtagtataaactaatacaccagtcttgtaaaccggagatgaaaacctttttccaaggacaaatcagagaaaaagtctttaactccaccattagcacccaaagctaagattctaatttaaactattctctgttctttcatggggaagcagatttgggtaccacccaagtattgactcacccatcaacaaccgctatgtatttcgtacattactgccagccaccatgaatattgtacggtaccataaatacttgaccacctgtagtacataaaaacccaatccacatcaaaaccccctccccatgcttacaagcaagtacagcaatcaaccctcaactatcacacatcaactgcaactccaaagccacccctcacccactaggataccaacaaacctacccacccttaacagtacatagtacataaagccatttaccgtacatagcacattacagtcaaatcccttctcgtccccatggatgacccccctcagataggggtcccttgaccaccatcctccgtgaaatcaatatcccgcacaagagtgctactctcctcgctccgggcccataacacttgggggtagctaaagtgaactgtatccgacatctggttcctacttcagggtcataaagcctaaatagcccacacgttccccttaaataagacatcacgatg

SEQ ID NO: 9133 - DNA, 2259 bp, Homo sapiens
cagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaa

SEQ ID NO: 9134 - DNA, 1890 bp, Homo sapiens
gacccacgcgtccggggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactaaaaaaaaaaaaa

SEQ ID NO: 9135 - DNA, 961 bp, Homo sapiens
ggcacgagggggcggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggattaaaaaaaaaaaaaaaaaaaaaaaaaaaaaaaaaaaaaaaaaaaa

SEQ ID NO: 9136 - DNA, 2497 bp, Homo sapiens
tcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttc

SEQ ID NO: 9137 - DNA, 2615 bp, Homo sapiens
aggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccatatggaagcccaactggggttgcgtctgaggcctgccccctgggctggggcctcagaccccctcagccttgggaccgtgcccacgagggtcttccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcaaaaaaaaaaaaaaaaaaaaaaaaaaaaaaaaaaaaaaaaa

SEQ ID NO: 9138 - DNA, 797 bp, Homo sapiens
ttttttttttttttttaattgtcagttcagtgttttaatctgacgcaggcttatgcggaggaaaatgttttcatgttacttatactaacattagttcttctatagggtggatagattgggtccaattggggttgggaggatgttcagtttaatattgtttggggattttttaaggtagtggggttgttgagcttgaacgctttcttaattgggtgggctgcttttaggcctactagtggggtgtttaaattttttactctcttttacagagggtttttctcctagtgtgttccaaagagcgtgttccctctttgggacttaacgagttaaattttacaaggggcatttagaagggtctctggtggggccaatatttcaacatgttggaatctaaaaatattccttattcttggggacaaccagtcttatcaccaggtctccggtaaggtttggtcgccttctaacctatataaaattcttccccactatattttggctaactataaacgggtggtcgctccttttaagctgtgttcttaaggtaagctccgtactgggtatccggggggtcttaagctttgggctctcccttggcaaagttaatttcctaagttaattccatttatcgcagaaggtataggggtaaagtccttggctatatttaggctgggctataattttccatctttccctttggggactatatctatggcgccaggttccaatttctatcggactatacttaattgggggtaccatggttggggctaaaaggttgtcccggtaaacagggtgcg

SEQ ID NO: 9139 - DNA, 575 bp, Homo sapiens
tttttttttttttttttcattttgctatttaccgagcatctttatgtgccagacaccatgcaaactgctaagaatacaaaatacagagcctctgtcctgggggaaggtagtcttcatttgcaatcaggaaaacgaacgtaaaggcacaggtataaaaggacctagtgtgttttaaaatagcaagaaactaagagtgtctgaagcttaaagtgagtggtgattaggaagaaatggaagcttcttcagcctgacaaaagccatctaggaaaaacccacagctaacatcatacttaatggtgaaagactaaaagcttttctcctaagatcagaaacaaaacaaagatgtctgcttttgtacttctattcaaccttttactggaggttctagccagggtaatggggcaggaaaaaaaaaaagtaaaggcatctagattgaaaagacagaagtaaaactctctctattcatggatgacataatcctattataaaaaatctcaaagaatctgcaaaaaaactactagaattaataaatgaatttagtaaagttgtgggatacaaaatcacaacacaaaagt

SEQ ID NO: 9140 - DNA, 551 bp, Homo sapiens
tcaaaatagggatttattataaaaactatacaaactttttatcactcacaaatgatgaaaaattttaaacaattagtatcctccctccaaaatagtgtgttctgtctttacagtcttcactggcagtgcattcagatagtatagaaaataacaaacattccatataactttgtccctacagtaaataattttttaaaacttttcatcaagtttcagtgttactgaagttaattatagacagtaaggattacagaataagcagtaaatggtcacctgcactgtatttttcaaagcaaaaattgttttatattttctatgttgttttatcctgccccaaacacttaaagcaaaagttaaagatttttccagttacctgaaacttcaaaaatctattgtactttgaaaaaactttaaaaagcagcatcatttaaatagtggttaactcataaacgtgtatgcaacaacattccacaaccctaataccactcaggcctgcagagtcaccagctcacaataattcagtgctctgaaagctggggggaaagcccctg

SEQ ID NO: 9141 - DNA, 4182 bp, Homo sapiens
atgctggtgggccagggcgcggggccgctggggcccgcggtggtcaccgccgcggtggtgctgctgctgagcggcgtggggccggcgcacggctcgcgcgacctcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgagtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgcttgaacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttatagcctcttcaaaggagtcaaccgattctgcctgtccaagcctggtgtgtacaaagtgacccctcgctcctgccaccggtttgagcaagcgttctatatctatgacacgtcttcacctagtatctttacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacaccaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtgacatcctgcacccatcctcacccctccgtagagcccctcgtgcaatgcaatgaatggaccctcctgtcactctgctgaacagaatttattttctgagtcaaatataatttattattattttcgtcaaagaagtatttaagctgtgctgtggtgtgagaatgtcattcttgatcttcagccttcgtttgcaaggagagttccagttgacgtggtgtttggttccatggcggggtaccctggggattcatctgttttcttcacttccctttgcatctgagatcctgttggaaaccacagcaacctgtattcattattaggaaataaaaatcgaaaaaaaggttcattcttttgtgttgtagttttg

SEQ ID NO: 9142 - DNA, 1639 bp, Homo sapiens
agcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgagccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaagaaacaattgggtacccagttaaattttcatttcagataaacaacaaataattttttagtataagtacattattgtttatctgaaagttttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 9143 - DNA, 960 bp, Homo sapiens; identical to SEQ ID NO: 9114

SEQ ID NO: 9144 - DNA, 2899 bp, Homo sapiens
cagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaatttataggagttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattc

SEQ ID NO: 9145 - DNA, 2308 bp, Homo sapiens
gagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagg

SEQ ID NO: 9146 - DNA, 2615 bp, Homo sapiens
gaattccgggaagccagacggttaacacagacaaagtgctgccgtgacactcggccctccagtgttgcggagaggcaagagcagcgaccgcgcacctgtccgcccggagctgggacgcgcgcccgggcggccggacgaagcgaggagggaccgccgaggctgcccccaagtgtaactccagcactgtgaggtttcagggattggcagaggggaccaaggggacatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattt

SEQ ID NO: 9147 - DNA, 1160 bp, Homo sapiens
cctccgacagcctctccacaggtaccatgaaggtctccgcggcacgcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctgaccacgacgagcagcagttacaaaaaccttccccaggctggacgtggtggctcagccttgtaatcccagcactttgggaggccaaggtgggtggatcacttgaggtcaggagttcgagacagcctggccaacatgatgaaaccccatgtgtactaaaaatacaaaaaattagccgggcgtggtagcgggcgcctgtagtcccagctactcgggaggctgaggcaggagaatggcgtgaacccgggagcggagcttgcagtgagccgagatcgcgccactgcactccagcctgggcgacagagcgagactccgtctcaaaaaaaaaaaaaaaaaaaaaaaaaatacaaaaattagccgcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgcaagggctctgtgacaaggaaggaagtcagcatgcctctagaggcaaggaagggaggaacactgcactcttaagcttccgccgtctcaacccctcacaggagcttactggcaaacatgaaaaatcgggg

SEQ ID NO: 9148 - DNA, 1791 bp, Homo sapiens
cctcgtgccagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagagaaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtacccacttgcagtcaaaatggaattcctcgaaaatgtatttgaaacttggacccccagtgatgccttgatgctgcaacgccttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcttggattaacttagataacttttgtagccagtggttatattgcttataatttaatgtacaatactattgaaactggtgagttctgattattaaatattctctgtaaatcagtaaacatgtataaagt

SEQ ID NO: 9149 - DNA, 1305 bp, Homo sapiens
ttttcttttgacttgtttgtggatggaatgtttacagacatttctaattactgctttaattaaataaattggatcaaaggccgttcgaggtatttttgttttgccgtttgtcgctcagaattggcattttgagaggtgattgatactgctaacaattttctagtactctagtttgtttcaagaagagattttgggtagacgtaatcttcacctttcaaattatataacaatacgaacattattttttatactgatcataatttccagatttggggagggggtgatcgtggcaggaaaagttgtatgtttgttagttgcatatggtgatttttgatttttcaatgctggtaggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttctttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactat

SEQ ID NO: 9150 - DNA, 2223 bp, Homo sapiens
acttcttttcttggctaagccgcgtttgtactgtgtcttaccatgcctgaaccggcaaaatccgctccggcgcctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggcactggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtttgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggcggcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttgctcagtttagcataacctcttatggattttcatcaaattcagcgtgttggtcactggaaagagccttttccttctccttttcttactctcccctcatggtgttcccctcttaaaggaggaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaa

SEQ ID NO: 9151 - DNA, 1666 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaagcactaaggttgcaaaagcttctcatttcagagagatgccaggatcctaagtgcctgccaaacttaccaattctaaggaataagtggatggatggcattactgattcctacattactgattgattctgcatccacaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaaaaa

SEQ ID NO: 9152 - DNA, 2480 bp, Homo sapiens
gacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggccatgacctctaacgtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagatggaccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgataggggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatttatgcacagaagaaaatctggaaagtgatttatcaggatgtgagcactcgttgtgtctggatgttacaaatatgggtggttttattttctttttccctgtttagcattttctagttttcttatcaggatgtgagcactcgttgtgtctggatgttacaaatatgggtggttttattttctttttccctgtttagcattttctagttttccactattattgtatattatctgtataataaaaaataattttagggttggg

SEQ ID NO: 9153 - DNA, 198 bp, Homo sapiens
  misc_feature (48)..(48): n= A, C, T or G
  misc_feature (71)..(71): n= A, C, T or G
acccaaactgagactgagttaattcctgatcagggttgaacttaaganttatacaagaaaatggtaggggncgaggaggttgtataaaggggaaaaaacaacaactgcaaaaagcccaagagcctgaatttagaccaatctatcatcttcctcctcttaaaaagaaaacaatttaaaagtttcaaaaaaaaaaaaaaa

SEQ ID NO: 9154 - DNA, 1845 bp, Homo sapiens
actgctctttggatagggactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaaccttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgacagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaatttttttaccaaagacaaattaaaaaaatgaataccatatttaaatggaataataaaggttttttaaaaacttaaaaaaaaaaaaaa

SEQ ID NO: 9155 - DNA, 3263 bp, Homo sapiens
gcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgtatcctccctgcagttggagggggcgggccacgtaggcatgtgcccttccccttccccacacagctctgtccccgttgcacaccctactccttaactccctcaaccaggccttcaataatctggagaatcttgtctttggcaaaggattccaagcaaagatcttccctgagaatgcttaggtgaaaggttgttaaggagaaatatatttactgaagctgtctgaagacagatgacgcttttcgattctgcaccttgtatagctcctggagttggagctggaagagaaggcctttgaaagcaagaaactttggtaccttctggccagctcccagggaaggtttgaggggaacaggcaaatttgggctgatgttttgcatctattcgctgggaggcggtccttgttcccaccagaagaagcagcaggaccaagttcactatggagttctgatgtgaagttaactcaatattagagaattctacttatttgagggaattgtgaagagcctaaatactagaggcaccaaatatctatggcagcaggaatcctgaccaaatcagaataactgttagattatttcctgtttggaataattcttgttcaattgctcatgtaatcaagaattgatgattcagttatttatggagaattaagtttataaagcaaattaagtgtcaaggccagattacttaaggaatgccacgtgctcagaaattcacagcagatgcaatctcatgtaaaaccctcatgtggtaaaacaaagatctatcatggttgcccttaatcttttctctttttttttttttttttttttgagacaaggctttactctgtcgcttaggctggagtgcagggatgtgatcactgaagccttgacctggtctcaagcaatcttccctcctcagtcttaccagtagctgggactaccagtgagtgccaccacacccagctactgttttaagtttttgtagagatggggtttcaccacattgcccaggctggtctcgaactcctgggctcaagtgatcctcctatttcagcctcccagagtgctggaattacaggtgtgagccactgtgcctggctgccctcatttctttgcccccctctaggacttgctttctccgcatagcccttttgcaggcttcagagttctttccatccagtagccccgggacttctctctgttagattttgtttccatatgtattaccttcacttgcttctttttttttttttttttgagatggagtctcgctctgtcacccatgctggagtgcagtggtgtgaacccagctcactggagcctctgcctcccaggttcaagcgattctcctgcctcagcctcccgagtagctgggattacatgagtgcgccaccataactggctaatttttgtatttttggtagagataggatttcaccatgttggttaggctggtcttgaactcctgaccttaagtggtccgcccgtcttggcctcccagagtgctgggattacaggggtgagccactgtgcctggcttttcagttgcttctgaaagaaaccattggctgggtgggatggcacacgcctgtagtcctagcactttgggaggtgtaggctggcggatggcttgggcccaggagttcaggaccagcttgggcaacatggagagaccctgtctctccaaaaagatgcaaaagttagccgggcatggtggtacgcacctatagtcccaggtactcgggaggctgaggtgggatgatcgcttgggcccaggagatcaaggctgcagtgagctgaaactgcaccactgcactccagcctgggcgacagagtgagattctgcctcaaaaataaaaaaaaataataaaaaaagaaaagatgccattgtggtggggcaaagttcttggcccactttgccttctctgccctctccacctgggcaggtggggccctgtttgtctttgcttttgtcctctcaccttctctcccatcatattccaggtaacctaaaatcctttcctgcccccatgaagaagtagatccaagcactctgccctccaacctgtgtccagggagcaaggccttcaacttccaccactggtcacccagcttaatgaattgactctcattgtctggcttcttttggaaagggtttaactgggttccccaaatgggaacacaccttgcccttcagactctgttgtccatcacctttccttttcccttttatgggaggaaagccagggtagggaagttatgtgagatttggggcagagctggtaaaaaaaagcatacatctacatccatgttctttttttttttttttttttttggagacggggtctcactctgttgcccaggctggagtgcagtggtgcgatcacagttcactgcaactttgaacttcctggctcaagggttcctccaacttcagcctcctgaatagctgggactacaggcatgtgtaccactgtactacctggctaaattttttttaattcaatttttttttttttttaagagatgggtctcactttgttgttcaggctggtctcaaactcctgggctcaagtgatctgcccacctcagcctcccgaagtgctgggattccaggtgcaagccaccacactcaacctcctacctccatgttctgggtatcattaaggtaatcagaatcctcctgctgtagtcacgcttacccttctaagcaggttccccaggattcagagagccccggatttctcctggactccatgtgcagatgcctagtatttccattctgaccgttgccctccttgttcttcttgcctccctagttctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgt

SEQ ID NO: 9156 - DNA, 597 bp, Homo sapiens
  misc_feature (546)..(546): n= A, C, T or G
gcggccgccaggtccctggagccgccgcctccccgctcccggcctcagctgtcgttgtccacaggaagggcggccccgcccagccgtggcgtccgaacgcagccgaggcaaccgaagtagcagggactggctgctagggattcgaggattctgatagggacaaatataattcctcagtgtttattcacttcatggccgcttggacatagacacccgggttaagggacccggaaggtgccttctgaaaatatggcgaccacccttcaattgtcacaggctgctcttaagggcgccattatttgaccatatcaaatatggagcctttctgacttctctggcctcatcgtcccacttgcccttaaataaagccgcttcggctgctttttctagtgggggaggcggggtgtctgggaagtagaggagaggcttcttgccttcaagaaagatgtaagggcccgaagcttcacttacccctctgtacccgcaatacgcaacggtcgatgattggcgacgatcccggaagaagctgcgcggtgattggcctgngactggcggagcatatgaagggaccccgcggtcctgaagcctatgttgaca

SEQ ID NO: 9157 - DNA, 5005 bp, Homo sapiens
gttagtttggcctattgcagcgtcccagcatctgtcgcgtttctcatgtgtgattgggctctggcggcccatcctggcggagacttcggctagcaggccccgctgcagaccccaggccggctcgggtctacctgcgccagcgctgtacctgggcgaccttggctttgcccccaccggtgacccggcccgcaggacgtgtgggtgccgctcagctccccccgcctcggccgccgacccccagctccccggcggggcctcctcctgccacgtgacgcccccgccaggggccccagcgccctcctcgcggccgcgccgttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggtaggtgtttgggtgctcgcggctgcggcgggcgggctgggggcagcggtggccgtgcattgccgcgctgcgaggacggcgctgggttcgcggccgcgaggagggtgtgcctttgccgcgccgcctacgtgcgggtccgggctccgcggggccgggtgcgggaccccgcagatcgtcacccgcaacccaggcagccccaccgcgagtgccgccggaccccctggacgccgctgccagaggcgttcgcgcctatctggtatgaggtccacagacccgattcttacaacctggcgctctaacctcgccaacgggccaggaaaaaaacagaacaaggaaaagaagaaaaagtctgttccaagtaataatgggactagacagtaactgtttgcactttcgtctcttatggaaaatatgattattttgatgctttagtattacagactgtatcagacatactcttaaaagtatttaaaaacgtggggtcctaaaaatttcctagatcgggacagctgataatgcgacttctgttagtctccgcatccaactttcagggcggaatggggatttctaccttttactgaatatactcctgtaattttgaatattttttctcatcaaatgtgttactttcatgttttaggaaaccaataaaaatcaaaaatagaaacacccagcttaggtcctccttcttccaggaatcctcctctaacccctccctcccaggcaggatcggaggcccctcccgggtgctttctggggcctcactgaggtcctggtcccctaagtcctcccccgcagcccctccgcgtattaacccaccggtctcgctgggctcagagattgcttacttagcacatggtaagtgattaatactgtttaatgaccgagggaaaagataaaatgttctctgatgtttcacgcttttcgctctgaagttaaatagtggtaaatttatatgcgcttagataagaacatttaacagttaaggatctggaaaagttgacgacgtccgatgtccgtgtttcctgatccagcagttgcacgcctgggtattcatccttaagaacaatgtttttcagaatttgaagtccattttagtgggtcgtaaagtcatttaaatggatgatcagaatttgtaaaacacagacggagaatagaacatcagtgtctctcaggtcataggggtgttcgctttatgaatctctctccccctcctcagtttcatacatacacaaatgtgtgtcatgatgtaaaacgtcattccttagtatgagtcatggacaaaaaagtttgaaagccactgccctagataaattttaatacatgtccacaagcagacgtgtacaagaaggttgactgtaatggcagaaaactggatgccgccttcatgcctacctgaaggagaaagataaattatacaccactcataaaaagggcacactgtacagtggccaatgaagtatttttgtgtttcaacacaaatgcctttcagtgttgaaccaaaaaaaaaaaaagttgccggagaatgctgtgtgatatcttctatgtaaaattcagaacctggtggagcaaagctgttgtttagggatgcatgtataggcattaaaagtagtaaagaaaaaaagtcaagctaatggtcatctcctagtggggaggagagggtcaggggctcagagatgctggaaatgctttatcgcctgacctgtgcaatggttacatgggtgtttgctttgtaactctttgttaaatgatacacactgggtttgaatgttacatttccccccaaatatgttaaaatatgggtgttgcaaactgaagaagcctgagtctagggctctccgtctgttattcttatttcctggcttctttttagaaaaaaaaaatcttgctcagggaggagtacctagggaatttatcagtaatgttttatttcataaattccatggtggacataccagtattcattaaattattctttatgtattcttataacttaatttataatatttcaaaaagcatttaggagaaaacatcatttggtgtgtttgctttcccaaaagtcacatttacatgttttgtacacaactggaatattttatatagtaattttagctaaaatcaaattttgttatgaaaaacgaaatactaaaaagtatataaaaatcacagaactttacagactttcagcgttttaaaatgctaacatattgtatttacctcaataatttctgttcctcagttctttcaggccacatttttagtgctcaatagcctcatatgactttaatattttattatattttattatgttatatattttacattatacattatagaacagaatatttccatcattgcagaaatttatattggaaaacattctggatacaaatatttgttatatacttgcagatattaaactgtagacattaatccttatgctttttgtcttaagatactctactattaatgaaatgtattctgaatatttttctaagaatttttaagtttatgttttgtccacattttgttctttaatttacctgagacatgtatatattgagatgtatatattttatgttatgagatcaagcttaattaattttcagattcccacatgaaaaggtaattgtcccaatatcagtgattagcagtgccacttctgtcacatacagtacccagatatgtttgggcttatttccaggctgttaatcctggtttatttgtcatttgaaaatactgcagattttcatttactgctgctttctatgtagtatattgttcagttctaagaatttaagattttttcattgtgatattttttcttcccctaagagatttgtagaaagtagtctagttccaatgtggaaggttttgtgagttatccttttgttactgatttctaatttgcactgtagttagcatacgtgtcaaggccaacaattctttgaaattcgagaattgctttatggttttaactgctccttgtatcatcaagaataatttgtactcacagacttttgaggcaatgtatgtaggtgtgtgtatatatataatatatacacatacactttatatatagattatatataatctctctgtagagtttatataaaaattaaatatatttatataaatgtatatatatatatgaataaaatctcctgtctctaaggtttatgtttcattaattcaggaaagttttgtcttttatctctttattttcacacatttttgtcctattctttaggagctatgattagacttctgttagacttcctcactctatcacccacatcttttaaggtagatttaatgtatttaatatattttttatccatgttgaattctacatatgttttttagttctataatttatgtacaacaaaaaaaagtgtgtagcttggtgaaatttacatatgtgtatacctttgtgattactacccagataaacatataaaacattttcattccttctgccccttcctatcaatggagccactcgcttcccccagtcaactactgtcccgatttctatgaccatgtattattttcaaatgtttttaaacttcatataaacggagtcatacagtttattcttttgttcacattgtattcatccatgttgcatgtataagaatttttgtttgttttttatttttgctttgtatcaagggttggcaaactatggcctgtgggccaattccaacccactgcatgtttctgtttataaaattttattgggctgtgttcacccaccactatgcctggataattttttgtatttttagtacagacggggtttcaccgcgttggccaggatggtcttgatctcctgacctcgtgatccacccgccttggcctcccaaagtgctgggattacaggtgtgagccaccgcgcccagcccactctcaagattttgaagacatttgcctttgttttcctccagaaactttatagttttagctgttggatctgtgattatcaccagttgatttttgtgtatggtgtgagggggggatcaagatttattttgtatatggacatccatctactctacacatttattgaaaaaaacaacacctttcttttcccattgaattgcgtggggactttgttaataaatgaatggtcatatatttgggtctgtttctggactctgttctttccacttggactaattatccattcttgcatcagtaccatacttttttaattactgtagtttatggtaagtcttgacatggtattgtaaaccctccagttttgttcttttaaacaaatgttttgactatttaagtgctttacatttccatataaattttcaaatgtgcttgtcaatgtccattaaaaaaaaaaaaaa

SEQ ID NO: 9158 - DNA, 387 bp, Homo sapiens
cacgaagtacttggcgtgcacgatgccgttagtgcccagcttggcgaattcgtagatacgcagctcgaggcctttgatttttttcaggcgctcgatggtggcgtcgtcggaggcacggagcattttcttctcgagcatgaagcgcgtcttcacgccgcggtcccccgctttgctcaaggcttcgatcacgcggtcgagcggttcgcccgctttgcccacggcgtacatttcgccgaaatcgagcgtcttcttcgcgccgtcgatcatttccacccaaacgtcggtgggattgctcatgtcgggcgcgtcgagtttcgcttccacgggcgaagtgtacacgagctcgaagccgggaacttcgaaggcggcggaagcggaaagggacac

SEQ ID NO: 9159 - DNA, 680 bp, Homo sapiens
ctaatttaaactattctctgttctttcatggggaagcagatttgggtaccacccaagtattgactcacccatcaacaaccgctatgtatctcgtacattactgccagccaccatgaatattgtacggtaccataaatacttgaccacctgtagtacataaaaacccaatccacatcaaaaccccctccccatgcttacaagcaagtacagcaatcaaccttcaactatcacacatcaactgcaactccaaagccacccctcacccactaggataccaacaaacctacccacccttaacagtacatagtacataaagccatttaccgtacatagcacattacagtcaaatcccttctcgtccccatggatgacccccctcagataggggtcccttgaccaccatcctccgtgaaatcaatatcccgcacaagagtgctactctcctcgctccgggcccataacacttgggggtagctaaagtgaactgtatccgacatctggttcctacttcagggccataaagcctaaatagcccacacgttccccttaaataagacatcacgatggatcacaggtctatcaccctattaaccactcacgggagctctccatgcatttggtattttcgtctggggggtgtgcacgcgatagcattgcgagacgctggagccggagcaccc

SEQ ID NO: 9160 - DNA, 4994 bp, Homo sapiens
ctcctgctcttctttccgcttggcctccaacagcctctgctgctcctcctgagcccgcctttccagcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctggaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagagctgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggtcagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaattttttttctaagaagctgtcctacaaagttgagctttgttagtttttcatgtgtaatatattataaatttatcttttgggatataataaatgctttcatat

SEQ ID NO: 9161 - DNA, 417 bp, Homo sapiens
tttttttttttttttttaaccgaaattaagtttattcacatcaaatatcaattatttggagtaattaatacaataaaaacaatttaaatcttattgctttgccagtttatacagttgcacatgaagaaaaggataaatcctaccttttaaagtaatttatatcttacctttttaatcaaattaaagagatactttataatcacacaagacatttaaatagtataatacattatataattacatgtcagaaggaatgagagcagttaagaataccacacgtaaagaaataattgttgacaacagaagtataaaccttatgtggataatctatttgctaggacttaatccctctgtaagaaaattaacctaagttaatataaggaggaatatatacaaacatttatcctgcaaatgact

SEQ ID NO: 9162 - DNA, 223 bp, Homo sapiens
ttttttttttttttaagcaccaaatcatcttcattagagctaaacagcctcctggaagtctaaccacacagcaaatgaaatggccatggtgactgagaggctaccccagcataaaccccagctcctggccagagggctgtgccctattagggaaacccaggaaggaggggatggggatggggctcccaaactcccgtctctcccttattggaccaaatggcca

SEQ ID NO: 9163 - DNA, 491 bp, Homo sapiens
tttgagacggactcactccagcctgggcaaggagagaaactccgtctcaaaaaaaaaaaattaattaattaaaaaaaagagtgtcaagtgttatgggagattggttaggtaagtactgaaagtggatgattggctttggcggttagtttgtcttgtgtctgagagccatttgtatagtggcaaatgttagatttctggaggctgaggaatggaagttaggaaatgcagacaattaaaaattcttcacacctttacattttgctattttttcctcagtgttttcttttgtagcacttctgactggtttattatttgctttttccttacaatgacattgttattctatagcattctgttgaagatgtaattacattttctcaatctgtgatgtcaggttgctttttgaagtataaaggtttaagaaatacataattacatatgatttttaagtgatcttctcggtcttcagttgattttttccatatataaat

SEQ ID NO: 9164 - DNA, 548 bp, Homo sapiens
gcacgagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttcccttttttttccttcttttcccaccccctccccctccatgtgaagatttgggtgcttaacatatca

SEQ ID NO: 9165 - DNA, 1296 bp, Homo sapiens
atccagcgccagctggagatcatgggcaaggaagtctcgggcgaccagatcgaggacatgttcgagcagggtaagtgggacgtgttttccgagaacttgctggccgacgtgaagggccgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgtcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtccctgaaaattccctggttctgttccattttgagcgaaattggccttgggaaaaaccacgttcttcctttccgattcttcatccggtctacggctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaaaaaaaaaaaaaaaaaaaaaaaaaaaaaaaaaaa

SEQ ID NO: 9166 - DNA, 5537 bp, Homo sapiens
cggacgcgtggggttttattttacaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatcctgttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccccgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctg

SEQ ID NO: 9167 - DNA, 487 bp, Homo sapiens
ttaagcattttctgcccacagaatgaaaacaacagcagagtcctgtgggcaagagggggaatcaggtgcccagaaagctgttttgtctccttccttccttatttaacacatgacctcaaggaagttaactaaactctctgggactctgagcctcttattgaagttaggaagagaaatattgttccttctcaacctcaagtcaccaaaggacaatgtggaggaacgtgccggttgcatgaggctcctgaaactcacaaacaccgtttccttcaaggaaaagaatggagccccttggggttttctgagtggctcacgtggccaggtataaggaagctacttttacctgcttggtgggaaacaaaaaattgattgtgtttcctcagatttttctcccagaacagaaactgttatctctttaaacataatacctttggtgcagacataaaatttatataatttccctgcatgggcaatgggaaaaatactt

SEQ ID NO: 9168 - DNA, 344 bp, Homo sapiens
ttttttttttttttttttgagacagagtctcactccgttgtccaggctggactagtgctaccatactgcatagtgcagttctagaataaagctaactaaagagaatcaataactaaatgcaatgtatgaaatttgattgcaaccttgatggaaaaaatagccataaatgataccttaagaacaaaaaggactaggaagtagacaatatagagaattgtttttaatttttttggtgtgataacttgtttcttatccttatttttgggatatactgaactagtaaagggtaaaatgtcatgttcagtgtgtggaaattgaaggagactaaggaaaacatgacaact

SEQ ID NO: 9169 - DNA, 470 bp, Homo sapiens
cttatcaaaatattttattttaggagacccctcaaaaaaagacccaccacattagacagacgccccaacaacacccttggcctttttttggtcttttctgtattttttcctttttaaatcaactaaaacaatttgatgcttaaaataaaagacaggaaatatttcctgatgagactttagtcgagaatatagatatatttctgatccgggggcgggtgatcaagggcgggggaggagaaggatgtgccaccagtggttcgcgaggttccgtttctcagctcaggagggagcctggctgcctggacccgggctagggacccagagctggggctccacaggcctgaccagggccagggaagaagaggttttgcatcctacctctgtccaacgcaaaacctcttctttcctggctaactcggtcctttgtggcagcctgactgaatccggggacaggacctaagacatgctga

SEQ ID NO: 9170 - DNA, 568 bp, Homo sapiens
ttttttttttcagtctattccccctgtctggaaggcccttcatcctactctcttggcctcttctaatttttttcagtggagtccaaagtactcataaacacattcattaaaaatgtaagaagccaaagggcaaaaaaaaaattttttttaatcagggatgaggagggaagctaagaattttaaaatagtaaatgaaaaatttagaaatatgtattttgtagaaaatagtagacttagcactaagatgaaatgtttttggtaaagtttttaatttgggagttttgctgattccttcttacccttcaggacaattcacagatatcaatcctttctggagttacccctgactccctcaacaccccaaaactctaaatgccacggtcatctgtttctatatcaaccttttaacatatttatggccaggcgtggtggctcatgcctgtaatcctagcactttgggaggccaaggcaggagtcactgcgcctggccaattttcatatttttagtagagacggggttttaccatgttggccacgctggtctcgaactcttgatctcaagtgatct

SEQ ID NO: 9171 - DNA, 5645 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactg

SEQ ID NO: 9172 - DNA, 365 bp, Homo sapiens
  misc_feature (1)..(365): n= A, C, T, G
atcacaggataagcaatagattgtgtgggaaataataacacaagagtaaagatgctgaaggactcttctggaactcaaagtgacagttttgaaggttctggcacagnaggaaaggatcacaacccatataaatggcnaatgntgaatttctctgaacactgtcacatatggggcatcaatttggaaaactctcaattgaggccccttccctaagatnacaacattgataacctgtcttnttctctcncttctttacnatccgnccaagtctactattccaagtttaaatatngttcagaaagttgtcagccttgttagtcagaaaaactcccatttagagccanccaaactaggcanaagaaatt

SEQ ID NO: 9173 - DNA, 322 bp, Homo sapiens
aatataaggacttccattggtgtgcaggtggattcgtggtgctaaactatgttatgtgggtgtgggggccgaggagggggttgtgctctggcagcggtggcgccctaaatgatctataggtaaactctaatggcttccgcagggggtgcagtgcggaggacaagagcttggggctctctggctgagtgatctgggggacactcaagcggtttgtttctgtagaaatgggaatcttaaggcctctctggaaagggtgtgagggggtcgagggggagcgggcgccgggccttttgcgcttcattaggtgggtttgctttgcgag

SEQ ID NO: 9174 - DNA, 20 bp, Artificial Sequence
  Primer
cacaatgtggccgaggactt

SEQ ID NO: 9175 - DNA, 20 bp, Artificial Sequence
  Primer
tgtggccgaggactttgatt

SEQ ID NO: 9176 - DNA, 20 bp, Artificial Sequence
  Primer
tggcttttaggatggcaagg

SEQ ID NO: 9177 - DNA, 20 bp, Artificial Sequence
  Primer
gggggcttagtttgcttcct

SEQ ID NO: 9178 - DNA, 20 bp, Artificial Sequence
  Primer
aagtgcagcgttccttttgc

SEQ ID NO: 9179 - DNA, 20 bp, Artificial Sequence
  Primer
agcgttccttttgcgagaga

SEQ ID NO: 9180 - DNA, 20 bp, Artificial Sequence
  Primer
cgggctgttttccaaacatt

SEQ ID NO: 9181 - DNA, 20 bp, Artificial Sequence
  Primer
gaagggacacgcaggtggta

SEQ ID NO: 9182 - DNA, 20 bp, Artificial Sequence
  Primer
taccacctgcgtgtcccttc

SEQ ID NO: 9183 - DNA, 21 bp, Artificial Sequence
  Primer
gaggcacttgttctgctgctg

SEQ ID NO: 9184 - DNA, 327 bp, Homo sapiens
ggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 9185 - DNA, 20 bp, Artificial Sequence
  Primer
acgagcctgcaccaaagtct

SEQ ID NO: 9186 - DNA, 20 bp, Artificial Sequence
  Primer
aaacaatggcatgcctccac

SEQ ID NO: 9187 - DNA, 20 bp, Artificial Sequence
  Primer
tcattacagcgggggcttag

SEQ ID NO: 9188 - DNA, 20 bp, Artificial Sequence
  Primer
gggggcttagtttgcttcct

SEQ ID NO: 9189 - DNA, 17 bp, Artificial Sequence
  Primer
acgagcctgcaccaaag

SEQ ID NO: 9190 - DNA, 18 bp, Artificial Sequence
  Primer
tcattacagcgggggctt
